(12) United States Patent
Kennedy et al.

(10) Patent No.: US 12,410,218 B2
(45) Date of Patent: *Sep. 9, 2025

(54) INSECTICIDAL PEPTIDE PRODUCTION AND COMBINATION OF CYSTEINE RICH PEPTIDES

(71) Applicant: Vestaron Corporation, Durham, NC (US)

(72) Inventors: Robert M. Kennedy, Dexter, MI (US); William Tedford, Calgary (CA); Christopher Hendrickson, Los Angeles, CA (US); Robert Venable, Lawrence, MI (US); Catherine L. Foune, Gobles, MI (US); John Mcintyre, Alto, MI (US); Alvar R. Carlson, Kalamazoo, MI (US); Lin Bao, Portage, MI (US)

(73) Assignee: Vestaron Corporation, Kalamazoo, MI (US)

( * ) Notice: Subject to any disclaimer, the term of this patent is extended or adjusted under 35 U.S.C. 154(b) by 0 days.

This patent is subject to a terminal disclaimer.

(21) Appl. No.: 17/930,683

(22) Filed: Sep. 8, 2022

(65) Prior Publication Data

US 2023/0257427 A1  Aug. 17, 2023

Related U.S. Application Data

(60) Continuation of application No. 16/865,193, filed on May 1, 2020, now Pat. No. 11,472,854, which is a division of application No. 15/390,153, filed on Dec. 23, 2016, now Pat. No. 10,669,319, which is a division of application No. 14/383,841, filed as application No. PCT/US2013/030042 on Mar. 8, 2013, now Pat. No. 9,567,381.

(60) Provisional application No. 61/729,905, filed on Nov. 26, 2012, provisional application No. 61/698,261, filed on Sep. 7, 2012, provisional application No. 61/644,212, filed on May 8, 2012, provisional application No. 61/608,921, filed on Mar. 9, 2012.

(51) Int. Cl.
*C07K 14/435* (2006.01)
*A01N 63/50* (2020.01)
*C12N 15/82* (2006.01)

(52) U.S. Cl.
CPC ........ *C07K 14/43518* (2013.01); *A01N 63/50* (2020.01); *C07K 14/43504* (2013.01); *C12N 15/8286* (2013.01); *C07K 2319/55* (2013.01); *Y02A 40/146* (2018.01)

(58) Field of Classification Search
CPC .............................................. C07K 14/43518
See application file for complete search history.

(56) References Cited

U.S. PATENT DOCUMENTS

| | | |
|---|---|---|
| 490,688 A | 1/1893 | Smith |
| 683,106 A | 9/1901 | Buit |
| 1,029,203 A | 6/1912 | Loewenthal |
| 1,636,688 A | 7/1927 | Harris |
| 3,714,140 A | 1/1973 | Sipos |
| 3,933,590 A | 1/1976 | Oguma et al. |
| 3,946,780 A | 3/1976 | Sellers |
| 4,363,798 A | 12/1982 | D'Orazio |
| 4,411,994 A | 10/1983 | Gilbert et al. |
| 4,943,434 A | 7/1990 | Lidert |
| 4,945,050 A | 7/1990 | Sanford et al. |
| 4,959,221 A | 9/1990 | Holmes |
| 4,988,623 A | 1/1991 | Schwarz et al. |
| 4,996,155 A | 2/1991 | Sick et al. |
| 5,023,182 A | 6/1991 | Vail |
| 5,045,469 A | 9/1991 | Payne et al. |
| 5,055,294 A | 10/1991 | Gilroy |
| 5,073,632 A | 12/1991 | Donovan |
| 5,104,974 A | 4/1992 | Sick et al. |
| 5,135,867 A | 8/1992 | Payne et al. |

(Continued)

FOREIGN PATENT DOCUMENTS

| | | |
|---|---|---|
| AU | 2001285900 B2 | 2/2005 |
| AU | 784649 B2 | 5/2006 |

(Continued)

OTHER PUBLICATIONS

Kumari et al., "Cysteine-Rich Peptide Family with Unusual Disulfide Connectivity from Jasminum sambac", J. Natural Products, 2015, vol. 78, pp. 2791-2799. DOI: 10.1021/acs.jnatprod.5b00762.*
Jennings et al., "Biosynthesis and insecticidal properties of plant cyclotides: The cyclic knotted proteins from Oldenlandia affinis", PNAS, 2001, vol. 98, No. 19, pp. 10614-10619. www.pnas.org/cgi/doi/10.1073/pnas.191366898.*
Figueiredo et al., "Heterologous Expression of an Insecticidal Gene From the Armed Spider (*Phoneutria nigriventer*)", J. Venom. Anim. Toxins kncl. Trop. Dis., 2008, vol. 14, No. 2, pp. 274-293.*

(Continued)

*Primary Examiner* — Suzanne M Noakes
(74) *Attorney, Agent, or Firm* — Honigman LLP; Jeffrey I. Lehrberg; Johnathan P. O'Brien

(57) ABSTRACT

New insecticidal proteins, nucleotides, peptides, their expression in plants, methods of producing the peptides, new processes, production techniques, new peptides, new formulations, and new organisms, a process which increases the insecticidal peptide production yield from yeast expression systems. The present invention is also related and discloses selected endotoxins we call cysteine rich insecticidal peptides (CRIPS) which are peptides derived from *Bacillus thuringiensis* (Bt) and their genes and endotoxins in combination with toxic peptides known as Inhibitor Cystine Knot (ICK) genes and peptides as well as with other types of insecticidal peptides such as trypsin modulating oostatic factor (TMOF) peptide sequences used in various formulations and combinations; of both genes and peptides, useful for the control of insects.

26 Claims, 22 Drawing Sheets

Specification includes a Sequence Listing.

(56) References Cited

U.S. PATENT DOCUMENTS

| | | |
|---|---|---|
| 5,153,131 A | 10/1992 | Wolf et al. |
| 5,153,133 A | 10/1992 | Schwarz et al. |
| 5,155,034 A | 10/1992 | Wolf et al. |
| 5,187,091 A | 2/1993 | Donovan et al. |
| 5,236,843 A | 8/1993 | Narva et al. |
| 5,281,530 A | 1/1994 | Sick et al. |
| 5,316,905 A | 5/1994 | Mori et al. |
| 5,322,687 A | 6/1994 | Donovan et al. |
| 5,330,908 A | 7/1994 | Spaulding |
| 5,356,623 A | 10/1994 | Von Tersch et al. |
| 5,372,817 A | 12/1994 | Locke et al. |
| 5,378,625 A | 1/1995 | Donovan et al. |
| 5,407,825 A | 4/1995 | Payne et al. |
| 5,411,736 A | 5/1995 | Locke et al. |
| 5,424,409 A | 6/1995 | Ely et al. |
| 5,436,136 A | 7/1995 | Hinnen et al. |
| 5,441,934 A | 8/1995 | Krapcho et al. |
| 5,530,195 A | 6/1996 | Kramer et al. |
| 5,545,820 A | 8/1996 | Gatehouse et al. |
| 5,560,909 A | 10/1996 | Rheaume et al. |
| 5,593,881 A | 1/1997 | Thompson et al. |
| 5,616,319 A | 4/1997 | Donovan et al. |
| 5,670,365 A | 9/1997 | Feitelson |
| 5,679,343 A | 10/1997 | Donovan et al. |
| 5,683,691 A | 11/1997 | Peferoen et al. |
| 5,688,764 A | 11/1997 | Johnson et al. |
| 5,723,756 A | 3/1998 | Peferoen et al. |
| 5,723,758 A | 3/1998 | Payne et al. |
| 5,736,135 A | 4/1998 | Goeddel et al. |
| 5,736,145 A | 4/1998 | Murali |
| 5,741,669 A | 4/1998 | Krapcho et al. |
| 5,743,477 A | 4/1998 | Walsh et al. |
| 5,753,492 A | 5/1998 | Schnepf et al. |
| 5,763,568 A | 6/1998 | Atkinson et al. |
| 5,766,927 A | 6/1998 | Baker et al. |
| 5,824,792 A | 10/1998 | Payne et al. |
| 5,831,011 A | 11/1998 | Payne et al. |
| 5,837,237 A | 11/1998 | Peferoen et al. |
| 5,858,353 A | 1/1999 | Miller et al. |
| 5,871,780 A | 2/1999 | Moss |
| 5,874,288 A | 2/1999 | Thompson et al. |
| 5,932,209 A | 8/1999 | Thompson et al. |
| 5,942,664 A | 8/1999 | Baum et al. |
| 5,959,182 A | 9/1999 | Atkinson et al. |
| 5,973,231 A | 10/1999 | Bradfisch et al. |
| 5,985,831 A | 11/1999 | Bradfisch et al. |
| 6,007,832 A | 12/1999 | Stapleton |
| 6,028,246 A | 2/2000 | Lambert et al. |
| 6,042,843 A | 3/2000 | McIntosh |
| 6,043,415 A | 3/2000 | Strizhov et al. |
| 6,048,839 A | 4/2000 | Bradfisch et al. |
| 6,063,605 A | 5/2000 | Ely et al. |
| 6,063,756 A | 5/2000 | Donovan et al. |
| 6,077,937 A | 6/2000 | Payne et al. |
| 6,096,708 A | 8/2000 | Payne et al. |
| 6,107,278 A | 8/2000 | Schnepf et al. |
| 6,110,707 A | 8/2000 | Newgard et al. |
| 6,130,074 A | 10/2000 | Brennan |
| 6,143,550 A | 11/2000 | Lambert et al. |
| 6,150,165 A | 11/2000 | Payne et al. |
| 6,150,589 A | 11/2000 | Payne et al. |
| 6,156,573 A | 12/2000 | Malvar et al. |
| 6,159,724 A | 12/2000 | Ehret |
| 6,165,715 A | 12/2000 | Collins et al. |
| 6,165,981 A | 12/2000 | Flaa et al. |
| 6,166,195 A | 12/2000 | Schnepf et al. |
| 6,171,586 B1 | 1/2001 | Lam et al. |
| 6,172,281 B1 | 1/2001 | Van Mellaert et al. |
| 6,177,075 B1 | 1/2001 | Christian et al. |
| 6,261,553 B1 | 7/2001 | Bradley et al. |
| 6,281,413 B1 | 8/2001 | Kramer et al. |
| 6,312,738 B1 | 11/2001 | O'Shea et al. |
| 6,320,100 B1 | 11/2001 | Koziel et al. |
| 6,326,351 B1 | 12/2001 | Donovan et al. |
| 6,391,649 B1 | 5/2002 | Chait et al. |
| 6,399,330 B1 | 6/2002 | Donovan et al. |
| 6,448,226 B1 | 9/2002 | Lambert et al. |
| 6,468,523 B1 | 10/2002 | Mettus et al. |
| 6,528,484 B1 | 3/2003 | Ensign et al. |
| 6,537,756 B1 | 3/2003 | Rupar et al. |
| 6,548,285 B1 | 4/2003 | Swinkels et al. |
| 6,570,005 B1 | 5/2003 | Schnepf et al. |
| 6,573,240 B1 | 6/2003 | Payne et al. |
| 6,583,264 B2 | 6/2003 | King et al. |
| 6,630,619 B1 | 10/2003 | East |
| 6,645,739 B2 | 11/2003 | Clark |
| 6,686,452 B2 | 2/2004 | Rupar et al. |
| 6,727,409 B1 | 4/2004 | Lambert et al. |
| 6,737,273 B2 | 5/2004 | Payne et al. |
| 6,780,408 B1 | 8/2004 | Bosch et al. |
| 6,784,337 B1 | 8/2004 | Atkinson et al. |
| 6,811,790 B1 | 11/2004 | Damaria et al. |
| 6,831,062 B2 | 12/2004 | Thompson et al. |
| 6,855,873 B1 | 2/2005 | Van Mellaert et al. |
| 6,949,626 B2 | 9/2005 | Donovan et al. |
| 6,962,705 B2 | 11/2005 | Malvar et al. |
| 6,991,790 B1 | 1/2006 | Lam et al. |
| 7,019,197 B1 | 3/2006 | Christou et al. |
| 7,138,568 B2 | 11/2006 | Payne et al. |
| 7,161,062 B2 | 1/2007 | Ffrench-Constant et al. |
| 7,173,106 B2 | 2/2007 | King et al. |
| 7,208,474 B2 | 4/2007 | Bermudez et al. |
| 7,208,656 B2 | 4/2007 | Isaac et al. |
| 7,214,788 B2 | 5/2007 | Guzov et al. |
| 7,227,056 B2 | 6/2007 | English et al. |
| 7,241,612 B2 | 7/2007 | Shapiro-Ilan et al. |
| 7,244,880 B2 | 7/2007 | Arnaut et al. |
| 7,250,501 B2 | 7/2007 | Malvar et al. |
| 7,268,275 B2 | 9/2007 | Ffrench-Constant et al. |
| 7,271,002 B2 | 9/2007 | Kotin et al. |
| 7,279,547 B2 | 10/2007 | King et al. |
| 7,304,206 B2 | 12/2007 | Malvar et al. |
| 7,332,594 B2 | 2/2008 | Baum et al. |
| 7,332,650 B2 | 2/2008 | Ali et al. |
| 7,354,993 B2 | 4/2008 | King et al. |
| 7,355,099 B2 | 4/2008 | Carozzi et al. |
| 7,361,808 B2 | 4/2008 | Boets et al. |
| 7,419,801 B2 | 9/2008 | Barr et al. |
| 7,476,781 B2 | 1/2009 | Abad et al. |
| 7,491,698 B2 | 2/2009 | Hey et al. |
| 7,504,229 B2 | 3/2009 | Donovan et al. |
| 7,504,253 B2 | 3/2009 | Reed et al. |
| 7,510,878 B2 | 3/2009 | Abad et al. |
| 7,511,188 B2 | 3/2009 | Ali et al. |
| 7,528,293 B2 | 5/2009 | Ali et al. |
| 7,572,587 B2 | 8/2009 | Rupar et al. |
| 7,582,147 B1 | 9/2009 | Parker et al. |
| 7,595,173 B2 | 9/2009 | Krebs et al. |
| 7,655,838 B2 | 2/2010 | Guzov et al. |
| 7,678,764 B2 | 3/2010 | Garigapati et al. |
| 7,777,100 B2 | 8/2010 | Ffrench-Constant et al. |
| 7,785,832 B2 | 8/2010 | Pan et al. |
| 7,943,819 B2 | 5/2011 | Baum et al. |
| 7,956,028 B2 | 6/2011 | Garigapati et al. |
| 8,226,938 B1 | 7/2012 | Meikle et al. |
| 8,314,208 B2 | 11/2012 | Collins |
| 8,541,366 B2 | 9/2013 | Carozzi et al. |
| 8,709,399 B2 | 4/2014 | Vidal et al. |
| 8,778,372 B2 | 7/2014 | Lloyd et al. |
| 8,993,295 B2 | 3/2015 | Seed et al. |
| 9,201,073 B2 | 12/2015 | Finley et al. |
| 9,217,140 B2 | 12/2015 | Ryali et al. |
| 9,320,816 B2 | 4/2016 | Zhou et al. |
| 9,429,566 B2 | 8/2016 | Marinier et al. |
| 9,567,381 B2 | 2/2017 | Kennedy et al. |
| 9,635,858 B2 | 5/2017 | Newberry et al. |
| 9,714,408 B2 | 7/2017 | Tanaka et al. |
| 10,023,836 B2 | 7/2018 | Akada |
| 10,273,333 B2 | 4/2019 | Maynard |
| 10,442,834 B2 | 10/2019 | Sajiki et al. |
| 10,563,169 B2 | 2/2020 | Von Hagen |
| 10,588,957 B2 | 3/2020 | Scholz et al. |
| 2001/0010932 A1 | 8/2001 | Schnepf et al. |
| 2001/0026939 A1 | 10/2001 | Rice et al. |

(56) References Cited

U.S. PATENT DOCUMENTS

| | | |
|---|---|---|
| 2001/0026941 A1 | 10/2001 | Held et al. |
| 2002/0015066 A1 | 2/2002 | Siwinski et al. |
| 2002/0152496 A1 | 10/2002 | Fischhoff et al. |
| 2003/0017967 A1 | 1/2003 | Asano et al. |
| 2003/0046726 A1 | 3/2003 | Koziel et al. |
| 2003/0054391 A1 | 3/2003 | Bulla, Jr. |
| 2003/0134310 A1 | 7/2003 | Cujec |
| 2003/0144192 A1 | 7/2003 | Donovan et al. |
| 2003/0167517 A1 | 9/2003 | Arnaut et al. |
| 2003/0167522 A1 | 9/2003 | Narva et al. |
| 2003/0182685 A1* | 9/2003 | Petell ............... C12N 15/8286 800/320.2 |
| 2003/0207806 A1 | 11/2003 | Ensign et al. |
| 2003/0229919 A1 | 12/2003 | Isaac et al. |
| 2004/0018982 A1 | 1/2004 | Schnepf et al. |
| 2004/0033523 A1 | 2/2004 | English et al. |
| 2004/0058860 A1 | 3/2004 | Payne et al. |
| 2004/0093637 A1 | 5/2004 | Malvar et al. |
| 2004/0123343 A1 | 6/2004 | La Rosa et al. |
| 2004/0194165 A1 | 9/2004 | Payne et al. |
| 2005/0091714 A1 | 4/2005 | Sunchis et al. |
| 2005/0097635 A1 | 5/2005 | Lambert et al. |
| 2005/0165215 A1 | 7/2005 | Bigelow |
| 2005/0227321 A1 | 10/2005 | Krebs et al. |
| 2006/0040352 A1 | 2/2006 | Retallack |
| 2006/0051822 A1 | 3/2006 | Donovan et al. |
| 2006/0174372 A1 | 8/2006 | Malvar et al. |
| 2006/0218666 A1 | 9/2006 | Isaac et al. |
| 2006/0242734 A1 | 10/2006 | King et al. |
| 2007/0020625 A1 | 1/2007 | Duchaud et al. |
| 2007/0061919 A1 | 3/2007 | Baum et al. |
| 2007/0074308 A1 | 3/2007 | Boets et al. |
| 2007/0163000 A1 | 7/2007 | Rupar et al. |
| 2007/0208168 A1 | 9/2007 | Guzov et al. |
| 2007/0245430 A1 | 10/2007 | Abad et al. |
| 2007/0277263 A1 | 11/2007 | Anderson et al. |
| 2008/0016596 A1 | 1/2008 | Abad et al. |
| 2008/0020968 A1 | 1/2008 | Abad et al. |
| 2008/0040827 A1 | 2/2008 | Donovan et al. |
| 2008/0047034 A1 | 2/2008 | Arnaut et al. |
| 2008/0109924 A1 | 5/2008 | Ali et al. |
| 2008/0120742 A1 | 5/2008 | Ali et al. |
| 2008/0120744 A1 | 5/2008 | Ali et al. |
| 2008/0120745 A1 | 5/2008 | Ali et al. |
| 2008/0120746 A1 | 5/2008 | Ali et al. |
| 2008/0120747 A1 | 5/2008 | Ali et al. |
| 2008/0127375 A1 | 5/2008 | Ali et al. |
| 2009/0099081 A1 | 4/2009 | Carozzi et al. |
| 2009/0183278 A1 | 7/2009 | Abad et al. |
| 2010/0055761 A1 | 3/2010 | Seed et al. |
| 2010/0081619 A1 | 4/2010 | Tedford et al. |
| 2012/0028286 A1 | 2/2012 | Saller |
| 2015/0148288 A1 | 5/2015 | Kennedy et al. |
| 2015/0257383 A1 | 9/2015 | Deisenroth et al. |
| 2018/0362598 A1 | 12/2018 | Carlson et al. |
| 2019/0261634 A1 | 8/2019 | Carlson et al. |
| 2020/0255482 A1 | 8/2020 | Kennedy et al. |

FOREIGN PATENT DOCUMENTS

| | | |
|---|---|---|
| CA | 2410153 A1 | 6/2004 |
| CN | 1199569 A | 11/1998 |
| CN | 1260397 A | 7/2000 |
| CN | 1366822 A | 9/2002 |
| CN | 1401772 A | 3/2003 |
| CN | 1199569 C | 5/2005 |
| CN | 1952151 A | 4/2007 |
| CN | 101003789 A | 7/2007 |
| CN | 104411714 A | 3/2015 |
| CN | 105420316 A | 3/2016 |
| CN | 106172504 A | 12/2016 |
| CN | 106367361 A | 2/2017 |
| CN | 106367361 B | 8/2019 |
| EP | 0431829 A1 | 6/1991 |
| EP | 0473645 B1 | 3/1998 |
| EP | 0834254 A1 | 4/1998 |
| EP | 1681351 A1 | 7/2006 |
| EP | 1812464 B1 | 10/2008 |
| EP | 3528617 A4 | 11/2020 |
| JP | 2005139167 A | 6/2005 |
| JP | 2007006895 A | 1/2007 |
| JP | 2008518624 A | 6/2008 |
| JP | 2009286708 A | 12/2009 |
| JP | 2012504623 A | 2/2012 |
| JP | 7227957 B2 | 2/2023 |
| MX | 9606262 A | 1/1998 |
| MX | PA01004361 A | 6/2003 |
| MX | PA02008705 A | 12/2004 |
| MX | PA03006130 A | 2/2005 |
| RU | 2278161 C1 | 6/2006 |
| RU | 2278181 C2 | 6/2006 |
| UA | 75317 C2 | 4/2006 |
| UA | 75570 C2 | 5/2006 |
| WO | 86/03777 A1 | 7/1986 |
| WO | 1991000915 A1 | 1/1991 |
| WO | 9202139 A1 | 2/1992 |
| WO | 9315192 A1 | 8/1993 |
| WO | 9502962 A1 | 2/1995 |
| WO | 1995034656 A1 | 12/1995 |
| WO | 9708197 A1 | 3/1997 |
| WO | 9808932 A1 | 3/1998 |
| WO | 199840490 A1 | 9/1998 |
| WO | 199840491 A2 | 9/1998 |
| WO | 2000026371 A1 | 5/2000 |
| WO | 2000026378 A1 | 5/2000 |
| WO | 2001014562 A1 | 3/2001 |
| WO | 2001034811 A2 | 5/2001 |
| WO | 2001047952 A2 | 7/2001 |
| WO | 2002014517 A1 | 2/2002 |
| WO | 2002015701 A2 | 2/2002 |
| WO | 2002057664 A2 | 7/2002 |
| WO | 2003042369 A2 | 5/2003 |
| WO | 2003082910 A1 | 10/2003 |
| WO | 2004016653 A2 | 2/2004 |
| WO | 2004020636 A1 | 3/2004 |
| WO | 2005066202 A2 | 7/2005 |
| WO | 2005082077 A2 | 9/2005 |
| WO | 2006052806 A2 | 5/2006 |
| WO | 2006053473 A1 | 5/2006 |
| WO | 2007027776 A2 | 3/2007 |
| WO | 2007045160 A1 | 4/2007 |
| WO | 2007062064 A2 | 5/2007 |
| WO | 2007087567 A2 | 8/2007 |
| WO | 2007107302 A2 | 9/2007 |
| WO | 2008036138 A2 | 3/2008 |
| WO | 2008132743 A2 | 11/2008 |
| WO | 2008153551 A1 | 12/2008 |
| WO | 2009155557 A2 | 12/2009 |
| WO | 2010039652 A2 | 4/2010 |
| WO | 2010133644 A2 | 11/2010 |
| WO | 2011084634 A1 | 7/2011 |
| WO | 2011117351 A1 | 9/2011 |
| WO | 2012038950 A1 | 3/2012 |
| WO | 2013040142 A2 | 3/2013 |
| WO | 2013134734 A2 | 9/2013 |
| WO | 2013166211 A2 | 11/2013 |
| WO | 2014173716 A1 | 10/2014 |
| WO | 2014200910 A2 | 12/2014 |
| WO | 2016044575 A1 | 3/2016 |
| WO | 2018075269 A1 | 4/2018 |
| WO | 2018175677 A1 | 9/2018 |
| WO | 2018207036 A1 | 11/2018 |
| WO | 2019176676 A1 | 9/2019 |
| WO | 2020056315 A1 | 3/2020 |
| WO | 2021216621 A2 | 10/2021 |

OTHER PUBLICATIONS

Andrews, David L. et al., "Characterization of the lipid acyl hydrolase activity of the major potato (*Solanum tuberosum*) tuber protein, patatin, by cloning and abundant expression in a baculovirus vector", Biochem. J., 1988, vol. 252, pp. 199-206Andrews, et al.,

(56) References Cited

OTHER PUBLICATIONS

Characterization of the lip acyl hydrolase activity of the major potato (*Solanum tuberosum*) tuber protein, patatin, by cloning and abundant expression in a baculovirus vector, Biochem. J., 1988, vol. 252, pp. 199-206.
Ayres, Nicola M. et al., Genetic Transformation of Rice, Critical Reviews in Plant Science, 1994, vol. 13, No. 3 pp. 219-239.
Barloy, F. et al., Cloning and Expression of the First Anaerobic Toxin Gene from *Clostridium bifermentans* subsp. Malaysia, Encoding a New Mosquitocidal Protein with Homologies to Bscillus thuringiensis Delta-Endotoxins, J of Bacteriology, Jun. 1996, vol. 178, No. 11, pp. 3099-3105.
Barloy, F. et al., Distribution of Clostridial cry-Like Genes Among Bacillus thuringiensis and Clostridium Strains, Current Microbiology, 1998, vol. 36, pp. 232-237.
BBC New Article: May 10, 2016, “Kew report makes new tally for nmber of world’s plants”, Retrieved from < https://www.bbc.com/news/science-environment-36230858 > on Sep. 23, 2019.
Benchabane, Meriem, et al. Preventing unintended proteolysis in plant protein biofactories, Plant Biotechnology Journal, No. 6, 2008, pp. 633-648.
Bommineni, V.R., et al., An Evaluation of Target Cells and Tissues used in Genetic Transformation of Cereals, Maydica, Apr. 1997, vol. 42, pp. 107-120.
Borovsky, D., et al., Expression of Aedes trypsin-modulating oostatic factor on the virion of TMV: A potential larvicide, Proc Natl Acad Sci, Dec. 12, 2006, vol. 103, No. 50, pp. 18963-18968.
Borovsky, D., Trypsin-modulating oostatic factor: a potential new larvicide for mosquito control, Journal of Experimental Biology, 2003 vol. 206, No. 21, pp. 3869-3875.
Bosmans, Frank et al., Sea Anemone Venom as a Source of Insecticidal Peptides Acting on Voltage-Gated Na+ Channels, Toxicon, V 49, No. 4, pp. 550-560, Mar. 2007; XP002705659, ISN:0041-0101.
Broderick, N.A. et al., Midgut Bacteria Required for Bacillus Thuringiensis Insecticidal Activity, PNAS, Oct. 10, 2006, vol. 103, No. 41., pp. 15196-15199.
Cavallini, C., Biological Action of Two Tomato Cysteine-Rich Miniproteins, Ph.D. Thesis; Dept of Biotechnology; University of Verona, 2010; XP002705655, retrieved from the internet: URL:http://www.univr.it/documenti/AllegaiOA/allegatooa.sub.—5484.pdf.
Chang, H.C., et al., De novo folding of GFP fusion proteins: high efficiency in eukaryotes but not in bacteria, Journal of Molecular Biology, Oct. 21, 2005, vol. 353, No. 2, pp. 397-409.
Chen, M.H., et al., Signal peptide-dependent targeting of a rice alpha-amylase and cargo proteins to plastids and extracellular compartments of plant cells, Plant Physiology, Jul. 2004, vol. 135, No. 3, pp. 1367-1377.
Cohen, Zachary P., Biological Control A Guide to Natural Enemies in North America, Anthony P. Shelton, Professor of Entomology, Cornell University , as an update dated “Last updated Feb. 25, 2015” by Zachary P. Cohen, Cornell UniversityShelton, Anthony, “Biological Control a Guide to Natural Enemies in North America”, as an update dated “Last updated Feb. 25, 2015” by Zachary P. Cohen, Cornell University.
Crickmore, N., et al., Revision of the Nomenclature for the Bacillus thuringiensis Pesticidal Crystal Proteins, Microbiology and Molecular Biology Reviews, vol. 62, No. 3, Sep. 1998, pp. 807-813.
Czapla, T.H. et al., Effect of Plant Lectins on the Larval Development of Europran Corn Borer (Lepidoptera: Pyralidae) and Southern Corn Rootworm (Coleoptera: Chrysomelidae) J. Econ. Entomol., Dec. 1990, vol. 83, No. 6, pp. 2480-2485.
Daskalova, S.M., et al., Engineering of N. benthamiana L. plants for production of N-acetylgalactosamine-glycosylated proteins, BMC Biotechnology, Aug. 24, 2010, vol. 10, No. 62.
Dauplais, M., et al., “On the convergent evolution of animal toxins”, Journal of Biological Chemistry, Feb. 14, 1997; vol. 272, No. 7, pp. 4302-4309.
De Loose, M., et al., The extensin signal peptide allows secretion of a heterologous protein from protoplasts, Gene, 1991, vol. 99, pp. 95-100.
Down, R.E et al., Insecticidal Spider Venom Toxin Fused to Snowdrop Lectin is Toxic to the Peach-potato Aphid, *Myzus Persicae* (Hemiptera: Aphididae) and the Rice Brown Planthopper, *Nilaparvata Lugens* (Hemiptera: Delphacidae), Pest Manag. Sci.,Jan. 2006, vol. 62, pp. 77-85.
Escoubas, P., et al., Structure and pharmacology of spider venom neurotoxins, Biochimie, vol. 82, Issues 9-10, Sep. 10, 2000, pp. 893-907.
Figueiredo, J E F, et al., Heterologous Expression of an Insecticidal Gene from the Armed Spider (*Phoneutria Nigriventer*), Jour of Venomous Animals and Toxins Including Tropical Diseases, vol. 14, No. 2, pp. 274-293, 2008 XP002705657, ISSN:1678-9199.
Fitches, E., et al., Fusion proteins containing insect-specific toxins as pest control agents: snowdrop lectin delivers fused insecticidal spider venom toxin to insect haemolymph following oral ingestion, J. Insect Physiol., Feb. 2004, vol. 50, pp. 61-71.
Fitches, E., et al., An evaluation of garlic lectin as an alternative carrier domain for insecticidal fusion proteins, Insect Science, 2008, vol. 15, pp. 483-495.
Fitches, E., et al., The insecticidal activity of recombinant garlic lectins towards aphids, Insect Biochem. Mol. Biol., 2008, vol. 38, pp. 905-915.
Fletcher, Jamie I. et al., The Structure of a Novel Insecticidal Neurotoxin, w-atracotoxin-HV1, from the venom of an Australian funnel web spider, Nature Structural Biology, Jul. 1997, pp. 559-566, vol. 4, No. 7.
Galvez, A., et al., Purification and characterization of a unique, potent, peptidyl probe for the high conductance calcium-activated potassium channel from venom of the scorpion *Buthus tamulus*, Journal of Biological Chemistry, Jul. 5, 1990; vol. 265, No. 19, pp. 11083-11090.
Gimenez-Gallego, G., et al., Purification, sequence, and model structure of charybdotoxin, a potent selective inhibitor of calcium-activated potassium channels, Proc. Natl. Acad. Sci., May 1988, vol. 85, No. 10, pp. 3329-3333.
Gressent, Frederic et al, Pea Albumin 1 Subunit b (PA1b), a Promising Bioinsecticide of Plant Origin, Toxins, vol. 3, No. 12, pp. 1502-1517, Dec. 2011; XP002705656, ISSN: 2072-6651.
Heath, et al., Characterization of the protease processing sites in a multidomain proteinase inhibitor precursor from Nicotuana alate, European Journal of Biochemistry, 1995, vol. 230, pp. 250-257.
Hellens, R. et al., A Guide to Agrobacterium Binary Ti Vectors, Trends in Plant Science, Oct. 2000, vol. 5, No. 10 pp. 446-451.
Hernandez-Campuzano, et al., Expression of a spider venom peptide in transgenic tobacco confers insect resistance, Toxicon, 2009, vol. 53, No. 1, pp. 122-128.
Hiei, et al., Efficient transformation of rice (*Oryza sativa* L.) mediated by Agrobacterium and sequence analysis of the boundaries of the T-NDA, The Plant Journal, 1994, vol. 6, No. 2, pp. 271-282.
Hofte, Herman, et al., Insecticidal Crystal Proteins of Bacillus thuringiensis, Microbiological Reviews, vol. 53, No. 2, Jun. 1989, pp. 242-255.
Ishida, et al., High efficiency transformation of maize (*Zea mays* L.) mediated by Agrobacterium tumefaciens, Nature Biotechnology, Jun. 1996, vol. 14, pp. 745-750.
Jennings et al., “Biosynthesis and insecticidal properties of plant cyclotides: The cyclic knotted proteins from Oldenlandia affinis”, PNAS, 98(19):10614-10619, 2001.
Jones et al., The Cys-Loop Ligand-Gated Ion Channel Gene Superfamily of the Nematode, Caenorhabditis Elegans; Invert Neurosci, 2008, vol. 8, pp. 41-47.
Khan, Sher Afzal, et al., “Spider venom toxin protects plants from insecdt attack”, Transgenic Research, 2006, vol. 15, pp. 349-357.
Kramer, K.J., et al., Sequence of a cDNA and expression of the gene encoding epidermal and gut chitinases of Manduca sexta, Insect Biochemistry and Molecular Biology, Sep. 1993, vol. 23, Issue 6, pp. 691-701.

(56) References Cited

OTHER PUBLICATIONS

Kumari et al., "Cysteine-Rich Peptide Family with Unusual Disulfide Connectivity from Jasminum sambac", Journal of Natural Products, 78:2791-2799, 2015.

Kwok, E.Y., et al., GFP-labelled Rubisco and aspartate aminotransferase are present in plastid stromules and traffic between plastids, Journal of Experimental Botany, Mar. 2004, vol. 55, No. 397, pp. 595-604.

Lambert, B. et al., A Bacillus thuringiensis Insecticidal Crystal Protein with a High Activity against Members of the Family Noctuidae, Applied & Environmental Microbiology, Jan. 1996, vol. 62, No. 1., pp. 80-86.

Lew, M.J. et al. Structure-Function Relationships of .omega.-Conotoxin GVIA, Journal of Biological Chemistry, 1997, vol. 272, No. 18, pp. 12014-12023.

Li, W P et al, Expression and Characterization of a Recombinant Cry1Ac Crystal Protein Fused with an Insect-Specific Neurotoxin Omega-ACTX-Hv1a in Bacillus Thuringiensis, Gene (Amsterdam), V 498, No. 2, pp. 323-327, Feb. 2012, XP002705660.
Marrone, et al., Improvements in Laboratory Rearing of the Southern Corn Rootworm, Diabrotica Undecimpuncta Howardi Barber (Coleoptera: Chrysomelidae), on an Artifical Diet and Corn J. of Economic Entomology, 1985, vol. 78, pp. 290-293.
Martinez, G et al, Toxin III From Anemonia-Sulcata Primary Structure, Febs Letters, V 84, No. 2, pp. 247-252; 1977; XP002705658, ISSN: 0014-5793.
McBride, et al., Controlled Expression of Plastid Transgenes in Plants Based on a Nuclear DNA-Encoded and Plastid-Targeted 17 RNA Polymerase, Proc. Natl. Acad. Sci., Jul. 1994, vol. 91, pp. 7301-7305.
McCormick, S. et al., Leaf Disc Transformation of Cultivated Tomato (L. *esculentum*) using Agrobacterium Trumefaciens, Plant Cell Reports, 1986, vol. 5, pp. 81-84.
Memelink, J. et al., Structure and Regulation of Tobacco Extensin, The Plant Journal, 1993, vol. 4, pp. 1011-1022.
UniProt entry X1P169, 2014.
Wolfson, J.L. and Murdock, L.L., "Diversity in digestive proteinase activity among insects", J. Chem. Ecol., (1990), vol. 16, pp. 1089-1102.
Wong, T.K. and Neumann, E., "Biochemical and Biophysical Research Communications", (Jul. 30, 1982) vol. 107, No. 2, pp. 584-587.
Yu et al., "Glutathionylation-triggered conformational changes of glutaredoxin Grx1 from the yeast *Saccharomyces cerevisiae*", Proteins, 2008, vol. 72, No. 3, pp. 1077-1083.
Zhang et al., "Cloning and Analysis of the First cry Gene from Bacillus popiliae", J of Bacteriology, Jul. 1997, vol. 179, No. 13, pp. 4336-4341.
Zhu et al., "Evolutionary origin of inhibitor cystine knot peptides", FASEB Jour., Sep. 2003, vol. 17, pp. 1765-1767.
Zimmermann, et al., "Protein translocation across the ER membrane", Biochimica et Biophysica Acta, (Jun. 27, 2010) Elsevier, Amsterdam, vol. 1808, No. 3, pp. 912-924.
International Search Report and Written Opinion issued in related PCT Application No. PCT/US2022/023079, dated Jul. 20, 2022.
Anonymous: "Liposome—Wikipedia", Jan. 15, 2021 (Jan. 15, 2021), XP055939036, URL:https://en.wikipedia.org/w/index.php?title=Liposome&oldid=1000611753.
Anthony Shelton, Ph.D., "Biological Control A Guide to Natural Enemies in North America", as an update dated "Last updated Feb. 25, 2015" by Zachary P. Cohen, Cornell University.
UniProt P07984 GUNA_CELFI—Endoglucanse A from C. fimi, Retrieved from < https://www.unitprot.org/uniprotkb/P07984/entry > on Aug. 4, 2022.
Angsuthanasombat, C. et al., "Directed Mutagenesis of the Bacillus Thuringiensis Cry11A Toxin Reveals a Crucial Role in Larvicidal Activity of Arginine-136 in Helix 4," Journal of Biochemistry and Molecular Biology, Sep. 2001, vol. 34, No. 5, pp. 402-407.
Anonymous: GSP: BAY44659, Retrieved from the Internet: 1-4 URL:http://ibis.internal.epo.org/exam/dbfetch.jsp?id=GSP:BAY44659 [retrieved on Oct. 15, 2020], 1 page.
Aronson, A. et al., "Why Bacillus thuringiensis insecticidal toxins are so effective: unique features of their mode of action," FEMS Microbiology Letters, 2001, vol. 195, pp. 1-8.
Benchabane, M. et al., "Preventing unintended proteolysis in plant protein biofactories", Plant Biotechnology Journal, No. 6, 2008, pp. 633-648.
Chambaud, I. et al. "The complete genome sequence of the murine respiratory pathogen Mycoplasma pulmonis", Nucleic Acids Research, Information Retrieval Ltd, vol. 29, No. 10, Jan. 1, 2001 (Jan. 1, 2001), pp. 2145-2153.
De Dianous, S. et al., "The Effect of the Mode of Application on the Toxicity of Androctonus australis Hector Insect Toxin", Pestic. Sci., 23:35-40, 1988.
De Maaged, R. et al., "How Bacillus thuringiensis has evolved specific toxins to colonize the insect world," Trends in Genetics, Apr. 2001, vol. 17, No. 4, pp. 193-199.
De Maaged, R. et al., "Identification of Bacillus Thuringiensis Delta-Endotoxin Cry1C Domain III Amino Acid Residues Involved in Insect Specificity," Applied and Environmental Microbiology, Oct. 1999, vol. 65, No. 10, pp. 4369-4374.
European Extended Search Report for EP Application No. 17862582.8, dated Oct. 26, 2020, pp. 22.
Guo, H. et al., "Protein tolerance to random amino acid change," PNAS, Jun. 2004, Vo. 101, No. 25, pp. 9205-9210.
Guo, L. et al., "Fractionation and identification of Alaska pollock skin collagen-derived mineral chelating peptides" Food Chemistry 173: 536-542, 2015.
Hallquiist, N. et al., "Lipopolysaccharide regulates cysteine-rich intestinal protein, a zincfinger protein, in immune cells and plasma", Journal of Leukocyte Biology, 59(2):172-177, 1996 (abstract only).
Harris, J. et al., "Rapid and general profiling of protease specificity by using combinatorial fluorogenic substrate libraries", PNAS, 97(14):7754-7759, 2000.
Helting, T. et al., :Structure of Tetanus Toxin,"The Journal of Biological Chemistry," Jan. 1977, vol. 252, No. 1, pp. 187-193.
Hofte, H. et al., "Insecticidal Crystal Proteins of Bacillus thuringiensis", Microbiological Reviews, vol. 53, No. 2, Jun. 1989, pp. 242-255.
NCBI, UniProtKB/Swiss-Prot. S0F209.1, Omega/Kappa-hexatoxin-Hv1h [Hydronyche versuta], Oct. 2014, 2 pages.
Ostergaard, S. et al., "Increasing galactose consumption by *Saccharomyces cerevisiae* through metabolic engineering of the GAL gene regulatory network," Nature Biotechnology, 2000, vol. 18, pp. 1283-1286.
Ostergaard, S. et al., "Physiological Studies in Aerobic Batch Cultivations of *Saccharomyces cerevisiae* Strains Harboring the MEL1," Biotechnology and Bioengineering, 2000, vol. 68, No. 3, pp. 252-259.
PCT International Search Report, PCT/US2017/055596, mailed Feb. 23, 2018 (6 pages).
Pineda, S. et al., "Diversification of a single ancestral gene into a successful toxin superfamily in highly venomous Australian funnel-web spiders," BCM Genomics, 2014, vol. 15, pp. 177-177.
Sainsbury, F. et al., "Multimodal Protein Constructs for Herbivore Insect Control", Toxins, vol. 4, Jun. 12, 2012 (Jun. 12, 2012), pp. 455-475.
Seltzer, J. et al., "Cleavage Specificity of Human Skin Type IV Collagenase (Gelatinase)," The Journal of Biological Chemistry 265(33): 20409-20413, 1990.
Shu, C. et al., "Current Patents Related to Bacillus thuringiensis Insecticidal Crystal Proteins", Recent Patents on DNA & Gene Sequences, 2009, vol. 3, No. 1, pp. 26-28.
Tabashnik, B. et al., "Insect resistance to Bt crops: lessons from the first billion acres", Nature Biotechnology, 31(6):510-521, 2013.
Tounsi, S. et al., "Cloning and study of the expression of a novel cry1la-type gene from *Bacillus thuringiensis* subsp. Kurstaki," J. Appl. Microbial., 2003, vol. 95, No. 1, pp. 23-28.
Tyndall, J. et al., "Proteases Universally Recognize Beta Strands In Their Active Sites", Chem. Rev., 105:973-999, 2005.
UniProt entry MYPU_2440, 2001, 3 pages.
UniProt entry X1P169, 2014, 3 pages.
Walters, F. et al., "An Engineered Chymotrypsin/Cathepsin G Site in Domain I Renders Bacillus thuringiensis Cry3A Active against

(56) References Cited

OTHER PUBLICATIONS

Western Corn Rootworm Larvae", Applied and Environmental Microbiology, 74(2):367-374, 2008.
Alpha-glactosidase 1, MEL1 UniProt P04824, Retrieved from < https://www.uniprot.org/uniprot/P04824 > on Apr. 6, 2022.
Gill, G. et al., "Mutants of GAL4 Protein Altered in an Activation Function", Cell, 1987, vol. 51, pp. 121-126.
Guardia, C. et al., "Structural basis of redox-dependent modulation of galectin-1 dynamics and function," Glycobiology, 2014, vol. 24, No. 5, pp. 424-441.
Yu, J. et al., "Glutathionylation-triggered conformational changes of glutaredoxin Grx1 from the yeast *Saccharomyces cerevisiae*," Proteins, 2008, vol. 72, No. 3, pp. 1077-1083.
Clark et al. "Environmental Fate and Effects of Bacillus thuringiensis," 2005, J. Agric. Food Chem., vol. 53, No. 12, pp. 4643-4653.
Ding et al., Ding et al., "Improving the Insecticidal Activity by Expression of a Recombnant cry1Ac Gene with Chitinase-Encoding Gene in Acrystalliferous Bascillus thuringiensis," 2008, Curr Microbiol vol. 56, pp. 442-446.
Godfrey et al., "Microorganisms and their byproducts, nematodes, oils," 2005, California Agriculture, vol. 59, No. 1, pp. 35-40.
Sadeghi et al., Ferritin acts as a target site for the snowdrop lectin (GNA) in the midgut of the cotton leafworm *Spodoptera littoralis*, 2008, Insect Science, vol. 15, pp. 513-519.
Johnson Janice H. et al, "Novel insecticidal peptides from *Tegenaria agrestis* spider venom may have a direct effect on the insect central nervous system", Archives of Insect Biochemistry and Physiology., vol. {0} 38, No. {0} 1, Dec. 6, 1998 (Dec. 6, 1998), p. 19-31.
Herzig Volker et al, "Evaluation of Chemical Strategies for Improving the Stability and Oral Toxicity of Insecticidal Peptides", BIOMEDICINES, vol. {0} 6, No. {0} 3, Aug. 28, 2018 (Aug. 28, 2018), p. 90.
Jai K. Kaushik et al, "Why Is Trehalose an Exceptional Protein Stabilizer? : An Analysis of the Thermal Stability of Proteins in the Presence of the Compatible Osmolyte Trehalose", Journal of Biological Chemistry,vol. {0} 278, No. {0} 29, Jul. 18, 2003 (Jul. 18, 2003), p. 26458-26465.
Windley Monique J. et al, "Spider-Venom Peptides as Bioinsecticides", Toxinis,vol. {0} 4, No. {0} 3, Mar. 22, 2012 (Mar. 22, 2012), p. 191-227.
Hassett Kimberly J et al, "Stabilization of a recombinant ricin toxin A subunit vaccine through lyophilization", European Journal of Pharmaceutics and Biopharmaceutics, Elsevier Science Publishers B. V., Amsterdam, NL,vol. {0} 85, No. {0} 2, Apr. 10, 2013 (Apr. 10, 2013), p. 279-286.
EBI accession No. GSP: BFF54949, Database accession No. BFF54949, "Eratigena agrestis toxic protein (TP), SEQ ID 1765", Sequence information for W02018075269, Jun. 14, 2018 (Jun. 14, 2018).
International Search Report and Written Opinion issued in related PCT Application No. PCT/US2021/028254, dated. Nov. 19, 2021.
Undheim Eivind A.B. et al, "Weaponization of a Hormone: Convergent Recruitment of Hyperglycemic Hormone into the Venom of Arthropod Predators", Structure, vol. 23, Issue 7, Jul. 7, 2015 (Jul. 7, 2015), pp. 1283-1292.
Venkatraman Ramanujam et al, "Residual Dipolar Couplings for Resolving Cysteine Bridges in Disulfide-Rich Peptides", Frontiers in Chemistry, vol. 7, Jan. 22, 2020 (Jan. 22, 2020), ISSN: 2296-2646, DOI: 10.3389/fchem.2019.00889.
Yan, F. et al., "Improved Insecticidal Toxicity by Fusing Cry1Ac of Bacillus thuringiensis with Av3 of Anemonia viridis", Current Microbiology, Published online Dec. 29, 2013 (May 2014), vol. 68, No. 5, p. 604-609.
US EPA: "Pesticide Product Lable, MADEX HP", Aug. 2, 2013 (Aug. 2, 2013), XP055836696, Retrieved from the Internet: URL:https://www3.epa.gov/pesticides/chem_search/ppls/069553-00001-20130802.pdf.
Andrews et al., "Characterizatino of the lipid acyl hydrolase activity of the major potato (*Solanum tuberosum*) tuber protein, patatin, by cloning and abundant expression in a baculovirus vector", Biochem. J., (1988), vol. 252, pp. 199-206.

Anonymous, "Electroporation Methods in Neuroscience", Cold Spring Harbor Laboratory Press, (2015), Editor Saito, T.
Baptista, R. P. et al., "Thermodynamics and mechanism of cutinase stabilization by trehaloseBiopolymers", (Jun. 1, 2008), vol. 89, pp. 538-547.
Beattie, G.M., et al., "Trehalose: a cryoprotectant that enhances recovery and preserves function of human pancreatic islets after long-term storage" Diabetes, (Mar. 1, 1997), vol. 46, pp. 519-523.
Berge, S. M. et al., "Pharmaceutically acceptable salts in detail", J. Pharmaceutical Sciences, (1977), vol. 66, pp. 1-19.
Bonnardel et al., "UniLectin3D, a database of carbohydrate binding proteins with curated information on 3D structures and interacting ligands", Nucleic Acids Res., (Jan. 8, 2019), vol. 47, No. D1, pp. D1236-D1244.
Buchanan et al., "Cycloheximide Chase Analysis of Protein Degradation in *Saccharomyces cerevisiae*", J Vis Exp., (Apr. 18, 2016), No. 110, p. 53975.
Chang, L.L., et al., "Mechanism of protein stabilization by sugars during freeze-drying and storage: native structure preservation, specific interaction, and/or immobilization in a glassy matrix?" Journal of Pharmaceutical Sciences, (Jul. 1, 2005) American Chemical Society and American Pharmaceutical Association, US vol. 94, No. 7, pp. 1427-1444.
Conrad, U. and Fielder, U., "Compartment-specific accumulations of recombinant immunoglobulins in plant cells: an essential tool for antibody production and immunomodulation of physiological functions and pathogen activity", Plant Mol Bio (1998) 38: pp. 101-109.
Crowe, J.H., et al., "Preservation of membranes in anhydrobiotic organisms: the role of trehaloseScience", J.H., (Feb. 17, 1984), vol. 223, pp. 701-703.
Daskalova et al., "Engineering of *N. benthamiana* L. plants for production of N-acetylgalactosamine-glycosylated proteins", BMC Biotechnology, Aug. 24, 2010, vol. 10, No. 62.
Davis, B.D. and Mingioli, E.S., "Mutants of *Escherichia coli* requiring methionine or vitamin B12", J. Bact., (1950), vol. 60, pp. 17-28.
Deloose et al., "The extensin signal peptide allows secretion of a heterologous protein from protoplasts", Gene, (Mar. 1, 1991) Elsevier Amsterdam, NL, vol. 99, No. 1, pp. 95-100.
Down et al., "Insecticidal Spider Venom Toxin Fused to Snowdrop Lectin is Toxic to the Peach-potato Aphid, *Myzus persicae*(Hemiptera: Aphididae) and the Rice Brown Planthopper, *Nilaparvata lugens* (Hemiptera: Delphacidae)", Pest Manag. Sci., Jan. 2006, vol. 62, pp. 77-85.
Dymond, J.S. and Lorsch, J. "*Saccharomyces cerevisiae* Growth Media, Laboratory methods in enzymology: cell, lipid and carbohydrate"; In: Methods in enzymology, (Dec. 18, 2013) ISSN 0076-6879 ; vol. 533; pp. 191-204.
Elbein, A.D., et al., "New insights on trehalose: a multifunctional molecule", Glycobiology, (Apr. 1, 2003) Oxford University Press, US Source info: vol. 13, No. 4, pp. 17R-27R.
Eldeeb et al., "A molecular toolbox for studying protein degradation in mammalian cells", J Neurochem, (20191100), vol. 151, No. 4, pp. 520-533.
European Extended Search Report, EP Application No. 17862582.8, dated Oct. 26, 2020, p. 22.
European Extended Search Report, EP Application No. 20191154.2, dated Oct. 21, 2020, 9 pages.
Figueiredo et al., "Heterologous Expression of an Insecticidal Gene from the Armed Spider (*Phoneutria nigriventer*)", Journal of Venomous Animals and Toxins Including Tropical Diseases, vol. 14, No. 2, pp. 274-293, 2008 XP002705657, ISSN: 1678-9199.
Fitches et al., "An evaluation of garlic lectin as an alternative carrier domain for insecticidal fusion proteins", Insect Science, 2008, vol. 15, pp. 483-495.
Fitches et al., "Fusion proteins containing insect-specific toxins as pest control agents: snowdrop lectin delivers fused insecticidal spider venom toxin to insect haemolymph following oral ingestion", J. Insect Physiol., Feb. 2004, vol. 50, pp. 61-71.
Fitches et al., "The insecticidal activity of recombinant garlic lectins towards aphids", Insect Biochem. Mol. Biol., 2008, vol. 38, pp. 905-915.

(56) References Cited

OTHER PUBLICATIONS

Fletcher et al., "The Structure of a Novel Insecticidal Neurotoxin, w-atracotoxin-HV1, from the venom of an Australian funnel web spider", Nature Structural Biology vol. 4, No. 7, pp. 559-566, 1997.
Galvez et al., "Purification and characterization of a unique, potent, peptidyl probe for the high conductance calcium-activated potassium channel from venom of the scorpion *Buthus tamulus*", Journal of Biological Chemistry, Jul. 5, 1990; vol. 265, No. 19, pp. 11083-11090.
Gillespie, A.T. and Claydon, N., "The use of entomogenous fungi for pest control and the role of toxins in pathogenesis", Pestic. Sci., (1989), vol. 27, pp. 203-215.
Gimenez-Gallego et al., "Purification, sequence, and model structure of charybdotoxin, a potent selective inhibitor of calcium-activated potassium channels", Proc. Natl. Acad. Sci., May 1988, vol. 85, No. 10, pp. 3329-3333.
Goldstein I.J. and Hayes C.E., "The Lectins: Carbohydrate-binding proteins of plants and animals", Adv. Carbohydr. Chem. Biochem., (1978), vol. 35, pp. 127-340.
Gressent et al., "Pea Albumin 1 Subunit b (PA1b), a Promising Bioinsecticide of Plant Origin", Toxins, vol. 3, No. 12, pp. 1502-1517, Dec. 2011; XP002705656, ISSN: 2072-6651.
Guardia et al., "Structural basis of redox-dependent modulation of galectin-1 dynamics and function", Glycobiology, 2014, vol. 24, No. 5, pp. 424-441.
Guo, N., et al., "Trehalose expression confers desiccation tolerance on human cells", Nat. Biotechnol., (Feb. 1, 2000), vol. 18, pp. 168-171.
Hajek, A., "Interactions between fungal pathogens and insect hosts", Annu. Rev. Entomol, (Jan. 1, 1994) Annual Reviews Inc.
Hashimoto, Y. et al., "Location and nucleotide sequence of the gene encoding the viral enhancing factor of the Trichoplusia ni granulosis virus", Journal of General Virology, (1991), vol. 72, pp. 2645-2651.
Heath et al., "Characterization of the protease processing sites in a multidomain proteinase inhibitor precursor from Nicotiana alata", European Journal of Biochemistry, (1995), vol. 230, pp. 250-257.
Hellens et al., "A Guide to Agrobacterium Binary Ti Vectors", Trends in Plant Science, Oct. 2000, vol. 5, No. 10 pp. 446-451.
Hengherr, S. et al., "Trehalose and anhydrobiosis in tardigrades—evidence for divergence in responses to dehydration", FEBS J., (20080000), vol. 275, pp. 281-288.
Hofte et al., "Insecticidal Crystal Proteins of Bacillus thuringiensis", Microbiological Reviews, vol. 53, No. 2, Jun. 1989, pp. 242-255.
Hurst, M.R.H et al., "The Main Virulence Determinant of Yersinia entomophaga MH96 Is a Broad-Host-Range Toxin Complex Active against Insects" Journal of Bacteriology, (Apr. 15, 2011) American Society for Microbiology, US, vol. 193, No. 8, pp. 1966-1980.
Khan et al., "Spider venom toxin protects plants from insect attack", Transgenic Research, 2006, vol. 15, pp. 349-357.
Kim, T.K. and Eberwine, J.H., "Mammalian cell transfection: the present and the future", (Jun. 13, 2010), vol. 397, No. 8, pp. 3173-3178.
Konishi T. and Harata, M. "Improvement of the transformation efficiency of *Saccharomyces cerevisiae* by altering carbon sources in pre-culture", Biosci Biotechnol Biochem., (Feb. 4, 2014), vol. 78, No. 6, pp. 1090-1093.
Kramer, K.J. et al., "Sequence of a cDNA and expression of the gene encoding epidermal and gut chitinases of Manduca sexta", Insects Biochemistry and Molecular Biology, (Sep. 1, 1993) Elsevier Ltd, vol. 23, No. 6, pp. 691-701.
Kumar et al., "Biological role of lectins: A review", J. Orofac. Sci., (2012), vol. 4, pp. 20-25.
Kwok et al., "GFP-labelled Rubisco and aspartate aminotransferase are present in plastid stromules and traffic between plastids", Journal of Experimental Botany, Mar. 2004, vol. 55, No. 397, pp. 595-604.
Lakhtin, V. et al., "Lectins of living organisms; The overview, Anaerobe", (Jun. 9, 2011) Elsevier, Amsterdam, NL, vol. 17, No. 6, pp. 452-455.

Lambert et al., "A Bacillus thuringiensis Insecticidal Crystal Protein with a High Activity against Members of the Family Noctuidae", Applied & Environmental Microbiology, Jan. 1996, vol. 62, No. 1, pp. 80-86.
Landsberg, M.J. et al., "3D structure of the Yersinia entomophaga toxin complex and implications for insecticidal activity", Proceedings of the National Academy of Sciences, (Dec. 20, 2011), vol. 108, No. 51, pp. 20544-20549.
Lew et al., "Structure-Function Relationships of ?-Conotoxin GVIA" Journal of Biological Chemistry, 1997, vol. 272, No. 18, pp. 12014-12023.
Lindbo JA, "TRBO: A high-efficiency tobacco mosiac virus RNA-based overexpression vector", Plant Physiology, (2007), vol. 145, pp. 1232-1240.
Lipperte, K. and Galinski, E.A., "Enzyme stabilization be ectoine-type compatible solutes: protection against heating, freezing and drying", Appl. Microbiol. Biotechnol., (Apr. 1, 1992), vol. 37, pp. 61-65.
Looke et al., "Extraction of genomic DNA from yeasts for PCR-based applications", Biotechniques, (20110500), vol. 50, No. 5, pp. 325-328.
Lugue et al., "The complete sequence of the Cydia pomonella granulovirus genome", J Gen Virol, (Oct. 1, 2001), vol. 82, pp. 2531-2547.
Marrone et al., "Improvements in laboratory rearing of the southern corn rootworm, *Diabrotica undecimpuncta* howardi Barber (Coleoptera: Chrysomelidae), on an artificial diet and corn", J. of Economic Entomology, (1985), vol. 78, pp. 290-293.
Martinez et al., "Toxin III From Anemonia-Sulcata Primary Structure", Febs Letters, V 84, No. 2, pp. 247-252; 1977; XP002705658, ISSN: 0014-5793.
Mcbride et al., "Controlled expression of plastid transgenes in plants based on a nuclear DNA-encoded and plastid-targeted T7 RNA polymerase", Proc. Natl. Acad. Sci. USA, (Jul. 1, 1994), vol. 91, pp. 7301-7305.
Mccormick et al., "Leaf Disc Transformation of Cultivated Tomato (L. *esculentum*) using Agrobacterium Trumefaciens", Plant Cell Reports, 1986, vol. 5, pp. 81-84.
Mccormick et al., "Rapid production of specific vaccines for lymphoma by expression of the tumor-derived single-chain Fv epitopes in tobacco plants", Proc. Natl. Acad. Sci. USA, (1999), vol. 96, No. 2, pp. 703-708.
Memelink et al., "Structure and regulation of tobacco extensin", Plant Journal, (1993), vol. 4, No. 6, pp. 1011-1022.
Mensink, M.A., et al., "How sugars protect proteins in the solid state and during drying (review): Mechanisms of stabilization in relation to stress conditions", European journal of pharmaceutics and biopharmaceutics, (May 1, 2017) Elsevier Science Publishers B.V., Amsterdam, NL, vol. 114, pp. 288-295.
Mukherjee et al., "Orally active acaricidal peptide toxins from spider venom", Toxicon, 2006, vol. 47, pp. 182-187.
NCBI, Database accession No. NC_002816.1 (https://www.ncbi.nlm.nih.gov/nuccore/NC_002816.1).
Norton et al., "The Cystine Knot Structure of Ion Channel Toxins and Related Polypeptides", Toxicon, vol. 36, No. 11, pp. 1573-1583, 1998.
Ostergaard et al., "Increasing galactose consumption by *Saccharomyces cerevisiae* through metabolic engineering of the GAL gene regulatory network," Nature Biotechnology, 2000, vol. 18, pp. 1283-1286.
Ostergaard et al., "Physiological Studies in Aerobic Batch Cultivations of *Saccharomyces cerevisiae* Strains Harboring the MEL1," Biotechnology and Bioengineering, 2000, vol. 68, No. 3, pp. 252-259.
Pena et al., "Effects of high medium pH on growth, metabolism and transport in *Saccharomyces cerevisiae*", FEMS Yeast Res, (Mar. 1, 2015), vol. 15, No. 2, p. fou005.
Pence, "The antimetabolite imidazole as a pesticide", California Agric., Jan. 1965, pp. 13-15.
Peña et al., "A Bacillus thuringiensis S-Layer Protein Involved in Toxicity against Epilachna varivestis (Coleoptera: Coccinellidae)", App & Environ Microbiology, Jan. 2006, vol. 72, No. 1, pp. 353-360.

(56) References Cited

OTHER PUBLICATIONS

Pogue et al., "Production of Pharmaceutical-Grade Recombinant Aprotinin and a Monoclonal Antibody Product Using Plant-Based Transient Expression Systems", Plant Biotechnology Journal, 2010, vol. 8, pp. 638-654.
Poinar, G.O. Jr and Hess, R., "Ultrastructure of 40-million-year-old insect tissue", Science, (Mar. 5, 1982), vol. 80, No. 215, pp. 1241-1242.
Potter, H. and Heller, R., "Transfection by Electroporation", Curr Protoc Mol Biol, (May 1, 2003).
Quintero-Hernandez et al., "Scorpion and Spider Venom Peptides: Gene Cloning and Peptide Expression", Toxicon, 2011, vol. 58, pp. 644-663.
Romanos, M.A. and Clare, J.J. "Culture of yeast for the production of heterologous proteins", Curr Protoc Prot Sci., (2015), 5.8.1-5.8.17, supplement 2.
Rowell et al., "Bt Basics for Vegetable Integrated Pest Management", University of Kentucky—College of Agriculture, UK Cooperative Extension Service, Jul. 2005.
Sathasivan et al., "Nucleotide sequence of a mutant acetolactate synthase gene from an imidazolinone-resistant *Arabidopsis thaliana* var. Columbia", Nucl. Acids Res., (1990), vol. 18, No. 8, p. 2188.
Shi et al., "Construction of Plant Expression Vector of Fusion Gene Ubiquitin and Signal peptide Sequence of Pathogenesis-related Protein 1a", Journal of Shihezi University (Natural Science), 2006, vol. 24, No. 3, pp. 265-269.
Shim et al., "NeuroBactrus, a Novel, Highly Effective, and Environmentally Friendly Recombinant Baculovirus Insecticide," Applied and Environmental Microbiology, 2013, vol. 79, No. 1, pp. 141-149.
Slade, L. and Levine, H., "Beyond Water Activity: Recent Advances Based on an Alternative Approach to the Assessment of Food Quality and Safety, Critical reviews in food science and nutrition", (Jan. 1, 1991) Taylor & Francis, USA, vol. 30, No. 2-3, pp. 115-360.
Smith, P.K. et al., "Measurement of protein using bicinchoninic acid", Analy Biochem (1985) vol. 150, pp. 76-85.
Staub, J.M. and Maliga, P., "Accumulation of D1 polypeptidde in tobacco plastids is regulated via the untranslated region of the psbA mRNA", The EMBO J. (1993) vol. 12 no. 2, pp. 601-606.
Staub, J.M. et al., "High-yield production of a human therapeuctic protein in tobacco chloroplasts", Nature Biotech. (Mar. 1, 2000), vol. 18, pp. 333-338.
Stoger et al., "Cereal crops as viable production and storage systems for pharmaceutical scFv antibodies", Plant Mol. Biol., (2000), vol. 42, pp. 583-590.
Sundaramurthi, P. and Suryanarayanan, R., "Trehalose Crystallization During Freeze-Drying: Implications On Lyoprotection", J. Phys. Chem. Lett., (Dec. 28, 2009), vol. 1, pp. 510-514.
Tabashnik et al., "Insect resistance to Bt crops: lessons from the first billion acres", Nature Biotechnology, 31(6):510-521, 2013.
Takahashi et al., "Solution structure of hanatoxin1, a gating modifier of voltage-dependent K+ channels: common surface features of gating modifier toxins", Journal of Molecular Biology, Mar. 31, 2000, vol. 297, Issue 3, pp. 771-780.
Terra, W.R. and Ferreira, C., Insect digestive enzymes: properties, compartmentalization and function, Comn. Biochem. Physiol., (1994), vol. 109B, pp. 1-62.
Tolmachov, O., "Designing plasmid vectors", Methods in Molecular Biology, Gene Therapy of Cancer (2009), vol. 542, pp. 117-129.
Turcanu V. and Williams N.A., "Cell identification and isolation on the basis of cytokine secretion: A novel tool for investigating immune responses", Nature Medicine, (Mar. 1, 2001) Nature Publishing Group US, New York, vol. 7, No. 3, pp. 373-376.
UniProt entry MYPU_2440, 2001.
Midoro-Horiuti et al., "Variable Expression of Pathogenesis-Related Protein Allergen in Mountain Cedar (*Juniperas ashei*) Pollen", J Immunol, 164(4):2188-2192, 2000.
Moran et al., "Molecular analysis of the sea anemone toxin Av3 reveals selectivity to insects and demonstrates the heterogeneity of receptor site-3 on voltage-gated Na+ channels", Biochem. J., 406:41-48, 2007.
Mukherjee, A.K., et al., Orally active acaricidal peptide toxins from spider venom, Toxicon, 2006, vol. 47, pp. 182-187.
Norton, Raymond S. et al., The Cystine Knot Structure of Ion Channel Toxins and Related Polypeptides, Toxicon, Apr. 1998, pp. 1573-1583, vol. 36, No. 11.
PCT International Search Report for PCT/US2013/030042, mailed Oct. 28, 2013, 6 pages.
Pence, R. J., The antimetabolite imidazole as a pesticide, California Agric., Jan. 1965, pp. 13-15.
Petit et al., Etude Structure/Fonction d'une Albumine Entomotoxique de Type Alb du Pois Chez le rix: Application GBP a la Protection Contre le Ravageur Sitophilus Oryzae. ["Structure-function study of an Alb-type entomotoxic albumin, isolated from garden pea, in rice : application to post-harvest protection again"], Ph.D. Dissertation. Etude Struction/Fonctition D'Une Albumine Entomotoxique De Type A1B Du Pois Chez Le Riz: Application GBP a La Protection Contre Le Ravageur Sitophilus Oryzae, Universite.
Pogue, GP, et al., Production of Pharmaceutical-Grade Recombinant Aprotinin and a Monoclonal Antibody Product Using Plant-Based Transient Expression Systems, Plant Biotechnology Journal, 2010, vol. 8, pp. 638-654.
Quintero-Hernandez, V., et al., "Scorpion and Spider Venom Peptides: Gene Cloning and Peptide Expression", Toxicon, 2011, vol. 58, pp. 644-663.
Raymond, Ben et al., "The impact of strain diversity and mixed infections on the evolution of resistance to Bacillus thuringiensis", Proceedings of the Royal Society B, 280:1-9 (http://dx.doi.org/10.1098/rspb.2013.1497), 2013.
Rowell, Brent et al., "Bt Basics for Vegetable Integrated Pest Management", University of Kentucky—College of Agriculture, UK Cooperative Extension Service, Jul. 2005.
Sambrook and Russell, Molecular Cloning: A Laboratory Manual, 2001, Table of Contents.
Shi, Fang-Fang et al., "Construction of Plant Expression Vector of Fusion Gene Ubiquitin and Signal peptide Sequence of Pathogenesis-related Protein 1a", Journal of Shihezi University (Natural Science), 24(3):265-269, 2006, Abstract is in English.
Shim et al., "NeuroBactrus, a Novel, Highly Effective, and Environmentally Friendly Recombinant Baculovirus Insecticide," Applied and Enviornmental Michrobiology, 2013, vol. 79, No. 1, pp. 141-149.
Shu, Changlong, et al., "Current Patents Related to Bacillus thuringiensis Insecticidal Crystal Proteins", Recent Patents on DNA & Gene Sequences, 2009, vol. 3, No. 1, pp. 26-28.
Stalker, et al., Purification and Properties of a Nitrilase Specific for the Herbicide Bromoxynil and Corresponding Nucleotide Sequence Analysis of the bxn Gene, J. Biol. Chem., May 5, 1988, vol. 263, No. 13, pp. 6310-6314.
Staub, J.M, et al., Accumulation of D1 polypeptide in tabacco plastids is regulated via the untranslated region of the psbA mRNA, EMBO J., 1993, vol. 12, No. 2 pp. 601-606.
Svab, et al., High-frequency plastid transformation in tobacco by selection for a chimeric aadA gene, Proc. Natl. Acad. Sci., Feb. 1993, vol. 90, pp. 913-917.
Svab, et al., Stable Transformation of Plastids in Higher Plants, Proc. Natl. Acad. Sci., Nov. 1990, vol. 87, pp. 8526-8530.
Takahashi, H., et al., "Solution structure of hanatoxin1, a gating modifier of voltage-dependent K+ channels: common surface features of gating modifier toxins", Journal of Molecular Biology, Mar. 31, 2000, vol. 297, Issue 3, pp. 771-780.
Van Damme, E.J.M., et al., "Biosynthesis, primary structure and molecular cloning of snowdrop (*Galanthus nivalis* L.) lectin", European Journal of Biochemistry, 1991, vol. 202, pp. 23-30.
Yokoyama et al., Novel cry gene from Paenibacillus lentimorbus strain Semadara inhibits ingestion and promotes insecticidal activity in Anomala cuprea larvae, J of Invertebrate Pathology, 2004, vol. 85, pp. 25-32.
Zhang et al., Cloning and Analysis of the First cry Gene from Bacillus popilliae, J of Bacteriology, Jul. 1997, vol. 179, No. 13, pp. 4336-4341.
Zhu, S., et al., "Evolutionary origin of inhibitor cystine knot peptides", FASEB Jour., Sep. 2003, vol. 17, pp. 1765-1767.

(56) References Cited

OTHER PUBLICATIONS

Zimmerman, R., et al., "Protein translocation across the ER membrane", Biochimica et Biophysica Acta, 2011, vol. 1808, pp. 912-924.

European Extended Search Report, Application No. 20191154.2, dated Oct. 21, 2020, 9 pages.

Office Action issued in related Chinese Patent Application No. 202180045271.7, dated Dec. 10, 2024.

Dipel® DF label, Valent BioSciences, LLC (2018).

Office Action issued in Japanese Patent Application No. JP2022-566417, dated Jun. 24, 2025.

* cited by examiner

INSECTICIDAL PEPTIDE PRODUCTION AND COMBINATION OF CYSTEINE RICH PEPTIDES

REFERENCE TO RELATED APPLICATIONS

This application is a continuation application of U.S. patent application Ser. No. 16/865,193, filed May 1, 2020, which is a divisional application of U.S. patent application Ser. No. 15/390,153, filed on Dec. 23, 2016, which is a divisional application of U.S. patent application Ser. No. 14/383,841, filed on Sep. 8, 2014, which is a 371 of PCT Application No. PCT/US2013/030042, filed on Mar. 8, 2013, which claims the benefit of earlier filed U.S. Provisional Application No. 61/608,921, filed on Mar. 9, 2012, U.S. Provisional Application No. 61/644,212, filed on May 8, 2012, U.S. Provisional Application No. 61/698,261, filed on Sep. 7, 2012, and U.S. Provisional Application No. 61/729,905, filed Nov. 26, 2012, the entire contents of which are incorporated herein by reference.

SEQUENCE LISTING

This application incorporates in its entirety the Sequence Listing XML entitled "225312-515818.xml" (2,061,915 bytes), which was created on Sep. 8, 2022, and filed electronically herewith.

FIELD OF THE INVENTION

New insecticidal proteins, nucleotides, peptides, their expression in plants, methods of producing the peptides, new processes, production techniques, new peptides, new formulations, and combinations of new and known organisms that produce greater yields than would be expected of related peptides for the control of insects are described and claimed.

BACKGROUND

The global security of food produced by modern agriculture and horticulture is challenged by insect pests. Farmers rely on insecticides to suppress insect damage, yet commercial options for safe and functional insecticides available to farmers are diminishing through the removal of dangerous chemicals from the marketplace and the evolution of insect strains that are resistant to all major classes of chemical and biological insecticides. New insecticides are necessary for farmers to maintain crop protection.

Insecticidal peptides are peptides that are toxic to their targets, usually insects or arachnids of some type, and often the peptides can have arthropod origins such as from scorpions or spiders. They may be delivered internally, for example by delivering the toxin directly to the insect's gut or internal organs by injection or by inducing the insect to consume the toxin from its food, for example an insect feeding upon a transgenic plant, and/or they may have the ability to inhibit the growth, impair the movement, or even kill an insect when the toxin is delivered to the insect by spreading the toxin to locus inhabited by the insect or to the insect's environment by spraying, or other means, and then the insect comes into some form of contact with the peptide.

Insecticidal peptides however have enormous problems reaching the commercial market and to date there have been few if any insecticidal peptides approved and marketed for the commercial market, with one notable exception, peptides derived from *Bacillis thuringiensis* or Bt. And now there is concern over rising insect resistance to Bt proteins.

Bt proteins, or Bt peptides, are effective insecticides used for crop protection in the form of both plant incorporated protectants and foliar sprays. Commercial formulations of Bt proteins are widely used to control insects at the larval stage. ICK peptides include many molecules that have insecticidal activity. Such ICK peptides are often toxic to naturally occurring biological target species, usually insects or arachnids of some type. Often ICK peptides can have arthropod origins such as the venoms of scorpions or spiders. Bt is the one and only source organism of commercially useful insecticidal peptides. Other classes and types of potential peptides have been identified, such as Trypsin modulating oostatic factor (TMOF) peptides. TMOF peptides have to be delivered to their physiological site of action in various ways, and TMOF peptides have been identified as a potential larvicides, with great potential, see D. Borovsky, Journal of Experimental Biology 206, 3869-3875, but like nearly all other insecticidal peptides, TMOF has not been commercialized or widely used by farmers and there are reasons for this.

The ability to successfully produce insecticidal peptides on a commercial scale, with reproducible peptide formation and folding, at a reasonable and economical price, can be challenging. The wide variety, unique properties and special nature of insecticidal peptides, combined with the huge variety of possible production techniques, can present an overwhelming number of approaches to peptide application and production, but few, if any, are commercially successful.

There are several reasons why so few of the multitude insecticidal peptides that have been identified have ever made it to market. First, most insecticidal peptides are either to delicate or not toxic enough to be used commercially. Second, insecticidal peptides are difficult and costly to produce commercially. Third, many insecticidal peptides quickly degrade and have a short half-life. Fourth, very few insecticidal peptides fold properly when then are expressed by a plant, thus they lose their toxicity in genetically modified organisms (GMOs). Fifth, most of the identified insecticidal peptides are blocked from systemic distribution in the insect and/or lose their toxic nature when consumed by insects. Bt proteins are an exception to this last problem and because they disrupt insect feeding they have been widely used.

Here we present several solutions to these major problems which have prevented commercialization and wide spread use of insecticidal peptides. In the first section, we describe how to create special expression cassettes and systems that allow plants to generate and express properly folded insecticidal peptides that retain their toxicity to insects.

In the second section, we describe how to make a relatively small change to the composition of a peptide and in so doing dramatically increase the rate and amount that can be made through fermentation. This process also simultaneously lowers the cost of commercial industrial peptide production. This section teaches how a protein can be "converted" into a different, more cost effective peptide, that can be produced at higher yields and yet which surprisingly is just as toxic as before it was converted. In the third and final section, we describe how to combine different classes of insecticidal peptides such that they can operate together in a synergistic manner to dramatically change and increase the toxicity and activity of the component peptides when compared to their individual components. This section also provides details and data to support our system, methods and peptide combinations and formulations to deal with a looming threat of the development and distribution of Bt resistant insects. Bt resistant insects represent the next great threat to the global supply of food and we teach those skilled in the art how to meet and defeat this threat.

SUMMARY OF THE INVENTION

This invention describes how to produce toxic insecticidal peptides in plants so they fold properly when expressed by the plants. It describes how to produce peptides in high yields in laboratory and commercial production environments using various vectors. It describes one class of toxic insecticidal peptide we call CRIPS which stands for Cysteine Rich Insecticidal Peptides (CRIPS). It describes another class of toxic insecticidal peptides we call PFIPS which stands for Pore Forming Insecticidal Proteins (PFIPS). And it describes how novel and synergistic combinations of CRIPS and PFIPS can be fashioned together and used for a variety of purposes, including the protection of crops against of Bt or *Bacillus thuringiensis* peptide resistant insects. We disclose how to make and use combinations of CRIPS and PFIPS to kill and control insects, even Bt resistant insects, at every low doses. Without being bound by theory, our understanding of Bt or *Bacillus thuringiensis* peptides and proteins, allows us to teach one ordinarily skilled in the art, to create novel methods, compositions, compounds (proteins and peptides) and procedures to protect plants and control insects.

We describe and claim a protein comprised of an Endoplasmic Reticulum Signal Peptide (ERSP) operably linked to a Cysteine Rich Insecticidal Protein (CRIP) such as an Inhibitor Cysteine Knot (ICK) motif protein wherein said ERSP is the N-terminal of said protein (ERSP-ICK). A peptide wherein said ERSP is any signal peptide which directs the expressed CRIP to the endoplasmic reticulum of plant cells. A peptide wherein said CRIP is an Inhibitor Cysteine Knot (ICK) protein. A peptide wherein said CRIP is a Non-ICK protein. A peptide wherein said ERSP is a peptide between 5 to 50 amino acids in length, originating from a plant. A peptide operably linked to a Translational Stabilizing Protein (STA), wherein said ERSP is the N-terminal of said protein and a Translational Stabilizing Protein (STA) may be either on the N-terminal side of the CRIP, which is optionally an ICK motif protein (ERSP-STA-ICK): or Non-ICK motif protein (ERSP-STA-Non-ICK) or on the C-terminal side of the ICK or Non-ICK motif protein (ERSP-ICK-STA) or (ERSP-Non-ICK-STA).

We describe and claim a peptide with an N-terminal dipeptide which is added to and operably linked to a known peptide, wherein said N-terminal dipeptide is comprised of one nonpolar amino acid on the N-terminal of the dipeptide and one polar amino acid on the C-terminal of the dipeptide, wherein said peptide is selected from a CRIP (Cysteine Rich Insecticidal Peptide), such as from an ICK peptide, or a Non-ICK peptide. A peptide with an N-terminal dipeptide which is added to and operably linked to a known peptide, where the N-terminal dipeptide is comprised of one nonpolar amino acid on the N-terminal of the dipeptide and one polar amino acid on the C-terminal of the dipeptide. A peptide where the non-polar amino acid from the N-terminal amino acid of the N-terminal dipeptide is selected from glycine, alanine, proline, valine, leucine, isoleucine, phenylalanine and methionine. A peptide where the polar amino acid of the C-terminal amino acid of the N-terminal peptide is selected from serine, threonine, cysteine, asparagine, glutamine, histidine, tryptophan, tyrosine. A peptide where the non-polar amino acid from the N-terminal amino acid of the N-terminal dipeptide is selected from glycine, alanine, proline, valine, leucine, isoleucine, phenylalanine and methionine and said polar amino acid of the C-terminal amino acid of the N-terminal peptide is selected from serine, threonine, cysteine, asparagine, glutamine, histidine, tryptophan, tyrosine. A peptide where the dipeptide is comprised of glycine-serine.

We describe a composition comprising at least two types of insecticidal protein or peptides wherein one type is a Pore Forming Insecticidal Protein (PFIP) and the other type is a Cysteine Rich Insecticidal Peptide (CRIP). A composition where the CRIP is a ICK and optionally, said ICK is derived from, or originates from, *Hadronyche versuta*, or the Blue Mountain funnel web spider, *Atrax robustus, Atrax formidabilis, Atrax infensus*, including toxins known as U-ACTX polypetides, U-ACTX-Hv1a, rU-ACTX-Hv1a, rU-ACTX-Hv1b, or mutants or variants. A composition where the CRIP is a Non-ICK CRIP and optionally said Non-ICK CRIP is derived from, or originates from, animals having Non-ICK CRIPS such as sea anemones, sea urchins and sea slugs, optionally including the sea anemone named *Anemonia viridi*, optionally including the peptides named Av2 and Av3 especially peptides similar to Av2 and Av3 including such peptides listed in the sequence listing or mutants or variants.

We describe a method to control Bt resistant insects comprising, creating composition of at least two types of peptides wherein one type of peptide is a pore forming insecticidal protein (PFIP) and the other type of peptide is a cysteine rich insecticidal peptide (CRIP) and the PFIP and CRIP proteins are selected from any of the compositions described herein and from any of the proteins provided in the sequence listing and then applying said composition to the locus of the insect. A method of controlling Bt resistant insects comprising protecting a plant from Bt resistant insects comprising, creating a plant which expresses a combination of at least two properly folded peptides wherein one type of peptide is a pore forming insecticidal protein (PFIP) and the other type of peptide is a cysteine rich insecticidal peptide (CRIP) and the PFIP and CRIP proteins are selected from any of the compositions described herein and from any of the proteins provided in the sequence listing. A method where the CRIP is administered any time during which the PFIP is affecting the lining of the insect gut. A method where the CRIP is administered following the testing of the insect for Bt resistance and wherein said insect tested positive for Bt resistance. We describe the application of any of the compounds described herein in solid or liquid form to either the insect, the locus of the insect or as a Plant Incorporated Protectant.

BRIEF DESCRIPTION OF THE DRAWINGS

In FIG. 17 the native Av3 strain is shown in light grey, the modified high production strain Av3+2 is shown in black.

BRIEF DESCRIPTION OF THE SEQUENCE LISTING

Figure 1:
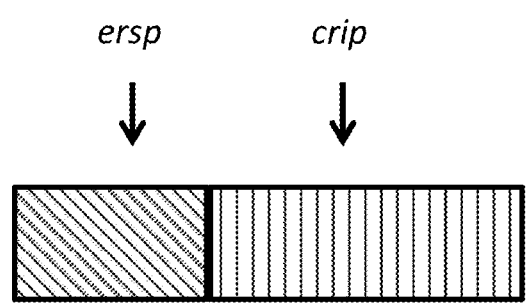
FIG. 1 is a diagram of invention of N-terminal fusion of ERSP (Endoplasmic Reticulum Signal Peptide in diagonal stripes) to a CRIP (Cysteine Rich Insecticidal Protein) such as ICK (Inhibitor Cysteine Knot) motif in vertical stripes).

This invention includes a sequence listing of 1593 sequences.

SEQ ID NOs: 1-28, 1553-1570, and 1593 are mentioned or referred to in Part 1.

SEQ ID NOs: 29-32, and 1571-1592 are mentioned or referred to in Part 2.

SEQ ID NOs: 33-1042 mentioned or referred to in Part 3.

SEQ ID NOs: 1043-1221 are sequences derived from or having a spider origin.

SEQ ID NOs: 1222-1262 are sequences derived from or having a sea anemone origin.

SEQ ID NOs: 1263-1336 are sequences derived from or having a scorpion origin.

SEQ ID NOs: 1337-1365 are sequences derived from or having a scorpion origin.

SEQ ID NOs: 1366-1446 are sequences derived from or having a Cry or Cyt origin.

SEQ ID NOs: 1447-1552 are sequences derived from or having a VIP origin.

DETAILED DESCRIPTION OF THE INVENTION

Definitions

"ACTX" or "ACTX peptide" means a Family of insecticidal ICK peptides that have been isolated from an Australian funnel-web spiders belonging to the Atracinae subfamily. One such spider is known as the Australian Blue Mountains Funnel-web Spider, which has the scientific name *Hydronyche versuta*. Two examples of ACTX peptides from this species are the Omega and U peptides.

"Agroinfection" means a plant transformation method where DNA is introduced into a plant cell by using Agrobacteria *A. tumefaciens* or *A. rhizogenes*.

"BAAS" means barley alpha-amylase signal peptide. It is an example of an ERSP.

"Binary vector" or "binary expression vector" means an expression vector which can replicate itself in both *E. coli* strains and *Agrobacterium* strains. Also, the vector contains a region of DNA (often referred to as t-DNA) bracketed by left and right border sequences that is recognized by virulence genes to be copied and delivered into a plant cell by *Agrobacterium*.

"Bt," also known as *Bacillus thuringiensis* or *B. thuringiensis*, means a gram-positive soil bacterium that has been used worldwide for more than sixty years to control agricultural, forestry, and public health insect pests.

"Bt proteins" and "Bt peptides" refer to the same thing here and these are peptides produced by Bt. Such peptides are frequently written as "cry", "cyt" or "VIP" proteins encoded by the cry, cyt and vip genes. Bt proteins are more usually attributed to insecticidal crystal proteins encoded by the cry genes. Bt proteins are examples of PFIPS (Pore Forming Insecticidal Proteins) see definition below. Examples PFIPS and other Bt proteins are provided in the sequence listing.

"Chimeric gene" means a DNA sequence that encodes a gene derived from portions of one or more coding sequences to produce a new gene.

"Cleavable linker" means a short peptide sequence in the protein that is the target site of proteases that can cleave and separate the protein into two parts or a short DNA sequence that is placed in the reading frame in the ORF and encoding a short peptide sequence in the protein that is the target site of protease that can cleave and separate the protein into two parts.

"Conditioned medium" means the cell culture medium which has been used by cells and is enriched with cell derived materials but does not contain cells.

"Conversion" or "converted" refers to the process of making an HP peptide.

"CRIP" and "CRIPS" is an abbreviation for Cysteine Rich Insecticidal Protein or Proteins. Cysteine rich insecticidal peptides (CRIPS) are peptides rich in cysteine which form disulfide bonds. CRIPS contain at least four (4) sometimes six (6) and sometimes eight (8) cysteine amino acids among proteins or peptides having at least 10 amino acids where the cysteines form two (2), three (3) or four (4) disulfide bonds. The disulfide bonds contribute to the folding, three-dimensional structure, and activity of the insecticidal peptide. The cysteine-cysteine disulfide bonds and the three dimensional structure they form play a significant role in the toxicity of these insecticidal peptides. A CRIP is exemplified by both inhibitory cysteine knot or ICK peptides (usually having 6-8 cysteines) and by examples of toxic peptides having disulfide bonds but that are not considered ICK peptides (Non-ICK CRIPS). Examples of an ICK would be an ACTX peptide from a spider and defined above. Examples of a Non-ICK CRIP would be a peptide like Av2 and Av3 which are peptides first identified from sea anemones. These peptides are examples of a class of compounds that modulate sodium channels in the insect peripheral nervous system (PNS). Non-ICK CRIPS can have 4-8 cysteines which form 2-4 disulfide bonds. These cysteine-cysteine disulfide bonds stabilized toxic peptides (CRIPS) can have remarkable stability when exposed to the environment. Many CRIPS are isolated from venomous animals such as spiders, scorpions, snakes and sea snails and sea anemones and they are toxic to insects. Additional description is provided below.

"Defined medium" means a medium that is composed of known chemical components but does not contain crude proteinaceous extracts or by-products such as yeast extract or peptone.

"Disulfide bond" means a covalent bond between two cysteine amino acids derived by the coupling of two thiol groups on their side chains.

"Double transgene peptide expression vector" or "double transgene expression vector" means a yeast expression vector which contains two copies of the insecticidal peptide expression cassette.

"ELISA" or "iELISA" means a molecular biology protocol in which the samples are fixed to the surface of a plate and then detected as follows: a primary antibody is applied followed by a secondary antibody conjugated to an enzyme which converts a colorless substrate to colored substrate which can be detected and quantified across samples. During the protocol, antibodies are washed away such that only those that bind to their epitopes remain for detection. The samples, in our hands, are proteins isolated from plants, and ELISA allows for the quantification of the amount of expressed transgenic protein recovered.

"Expression ORF" means a nucleotide encoding a protein complex and is defined as the nucleotides in the ORF.

"ER" or "Endoplasmic reticulum" is a subcellular organelle common to all eukaryotes where some post translation modification processes occur.

"ERSP" or "Endoplasmic reticulum signal peptide" is an N-terminus sequence of amino acids that during protein translation of the transgenic mRNA molecule is recognized and bound by a host cell signal-recognition particle, which moves the protein translation ribosome/mRNA complex to the ER in the cytoplasm. The result is the protein translation is paused until it docks with the ER where it continues and the resulting protein is injected into the ER.

"ersp" means a nucleotide encoding the peptide, ERSP.

"ER trafficking" means transportation of a cell expressed protein into ER for post-translational modification, sorting and transportation.

"FECT" means a transient plant expression system using Foxtail mosaic virus with elimination of coating protein gene and triple gene block.

"GFP" means a green fluorescent protein from the jellyfish *Aequorea victoria*. It is an example of a translational stabilizing protein.

"High Production peptide" or "HP peptide" means a peptide which is capable of being made, or is "converted," according to the procedures described herein and which, once converted can be produced at increased yields, or higher rates of production, or in greater than normal amounts, in a biological system. The higher rates of production can be from 20 to 400% or greater than can be achieved with a peptide before conversion, using the same or similar production methods that were used to produce the peptide before conversion.

"Hybrid peptide," aka "hybrid toxin," aka "hybrid-ACTX-Hv1a," aka "native hybrid-ACTX-Hv1a," as well as "U peptide," aka "U toxin," aka "native U," aka "U-ACTX-Hv1a." aka "native U-ACTX-Hv1a," all refer to an ACTX peptide, which was discovered from a spider known as the Australian Blue Mountains Funnel-web Spider, *Hydronyche versuta*, and is a dual antagonist to insect voltage-gated $Ca^{2+}$ channels and voltage-gated $K^{+}$ channels.

"IGER" means a name for a short peptide, based on its actual sequence of one letter codes. It is an example of an intervening linker.

"ICK motif," "ICK motif protein," "inhibitor cystine knot motif," "Toxic insect ICK peptides." "ICK peptides." "CK" peptides." "cystine knot motif," or "cystine knot peptides" means a 16 to 60 amino acid peptide with at least 6 half-cystine core amino acids having three disulfide bridges, wherein the 3 disulfide bridges are covalent bonds and of the six half-cystine residues the covalent disulfide bonds are between the first and fourth, the second and fifth, and the third and sixth half-cystines, of the six core half-cystine amino acids starting from the N-terminal amino acid. In general this type of peptide comprises a beta-hairpin secondary structure, normally composed of residues situated between the fourth and sixth core half-cystines of the motif, the hairpin being stabilized by the structural crosslinking provided by the motif's three disulfide bonds. Note that additional cysteine/cystine or half-cystine amino acids may be present within the inhibitor cystine knot motif. Examples are provided in the sequence listing.

"ick" means a nucleotide encoding an ICK motif protein.

"ICK motif protein expression ORF" or "expression ORF" means a nucleotide encoding a ICK motif protein complex and is defined as the nucleotides in the ORF.

"ICK motif protein expression vector" or "ICK expression vector, or "ICK motif expression vector," means a binary vector which contains an expression ORF. The binary vector also contains the necessary transcription promoter and terminator sequence surrounding the expression ORF to promote expression of the ORF and the protein it encodes.

"Insect" means any arthropod and nematode, including acarids, and insects known to infest all crops, vegetables, and trees and includes insects that are considered pests in the fields of forestry, horticulture and agriculture. Examples of specific crops that might be protected with the methods disclosed herein are soy bean, corn, cotton, alfalfa and the vegetable crops. A list of specific crops and insects appears towards the end of this document.

"Insect gut environment" or "gut environment" means the specific pH and proteinase conditions found within the fore, mid or hind gut of an insect or insect larva.

"Insect hemolymph environment" means the specific pH and proteinase conditions of found within an insect or insect larva.

"Insecticidal activity" means that on or after exposure of the insect to compounds or peptides, the insect either dies stops or slows its movement or it's feeding, stops or slows its growth, fails to pupate, cannot reproduce or cannot produce fertile offspring.

"Insecticidal peptide" or "Insecticidal protein" or "toxic peptide" or "toxic protein" means a protein having insecticidal activity when ingested by, in contact with, or injected into an insect.

"Insecticidal peptide production strain screen" means a screening process that identifies the higher-yielding insecticidal peptide production yeast strains from the lower yielding strains. In the described methods herein, it refers to screens that use reverse-phase HPLC or the housefly injection bioassay.

"Integrative expression vector or integrative vector" means a yeast expression vector which can insert itself into a specific locus of the yeast cell genome and stably becomes a part of the yeast genome.

"Intervening linker" means a short peptide sequence in the protein separating different parts of the protein, or a short DNA sequence that is placed in the reading frame in the ORF to separate the upstream and downstream DNA sequences such that during protein translation the proteins encoded in the DNA can achieve their independent secondary and tertiary structure formation. The intervening linker can be either resistant or susceptible to cleavage in plant cellular environments, in the insect and/or lepidopteran gut environment, and in the insect hemolymph and lepidopteran hemolymph environment.

"Known peptide" means a peptide known to have biological activity and may be a mature peptide or any version or fragment thereof including pre and pro peptides and conjugates of active peptides. A preferred known peptide is one with insecticidal activity.

"L" in the proper context means an intervening linker peptide, which links a translational stabilizing protein with an ICK motif protein or a multiple ICK motif protein domain, and links same or different multiple ICK motif protein. When referring to amino acids, "L" can also mean leucine.

"Linker, LINKER" or in some contexts "L" means an intervening linker peptide, which links a translational stabilizing protein with a ICK motif protein or a multiple ICK motif protein domain, and links same or different multiple ICK motif proteins. The linker can have one of (at least) three roles: to cleave in the insect gut environment, to cleave in the plant cell, or to be designed not to intentional cleave.

"l" or linker" means a nucleotide coding for an intervening linker peptide.

"Lepidopteran gut environment" means the specific pH and proteinase conditions of found within the fore, mid or hind gut of a lepidopteran insect or larva.

"Lepidopteran hemolymph environment" means the specific pH and proteinase conditions of found within lepidopteran insect or larva.

"Multiple ICK motif protein domain" means a protein composed of multiple ICK motif proteins which are linked by multiple intervening linker peptides. The ICK motif proteins in the multiple ICK motif protein domain can be same or different, and the intervening linker peptides in this domain can also be the same or different.

"Non-ICK CRIPS" can have 4-8 cysteines which form 2-4 disulfide bonds. Non-ICK peptides include cystine knot peptides that are not ICK peptides. Non-ICK peptides may have different connection orders of the cystine bonds than ICKs. Examples of a Non-ICK CRIP are peptides like Av2 and Av3 which are peptides first identified from sea anemones. These anemone peptides are examples of a class of compounds that modulate sodium channels in the insect peripheral nervous system (PNS).

"Non-Polar amino acid" is an amino acid that is weakly hydrophobic and includes glycine, alanine, proline, valine, leucine, isoleucine, phenylalanine and methionine. Glycine or gly is the most preferred non-polar amino acid for the dipeptides of this invention.

"Normalized peptide yield" means the peptide yield in the conditioned medium divided by the corresponding cell density at the point the peptide yield is measured. The peptide yield can be represented by the mass of the produced peptide in a unit of volume, for example, mg per liter or mg/L, or by the UV absorbance peak area of the produced peptide in the HPLC chromatograph, for example, mAu·sec. The cell density can be represented by visible light absorbance of the culture at wavelength of 600 nm (OD600).

"One letter code" means the peptide sequence which is listed in its one letter code to distinguish the various amino acids in the primary structure of a protein. alanine=A, arginine=R, asparagine=N, aspartic acid=D, asparagine or aspartic acid=B, cysteine=C, glutamic acid=E, glutamine=Q, glutamine or glutamic acid=Z, glycine=G, histidine=H, isoleucine=I, leucine=L, lysine=K, methionine=M, phenylalanine=F, proline=P, serine=S, threonine=T, tryptophan=W, tyrosine=Y, valine=V.

"Omega peptide" aka "omega toxin," aka "omega-ACTX-Hv1a," aka "native omega-ACTX-Hv1a." all refer to an ACTX peptide which was first isolated from a spider known as the Australian Blue Mountains Funnel-web Spider, *Hydronyche versuta*, and which is an antagonist to the insect voltage-gated $Ca^{2+}$ channel.

"ORF" or "Open reading frame" or "peptide expression ORF" means that DNA sequence encoding a protein which begins with an ATG start codon and ends with a TGA, TAA or TAG stop codon. ORF can also mean the translated protein that the DNA encodes.

"Operably linked" means that the two adjacent DNA sequences are placed together such that the transcriptional activation of one can act on the other.

"PEP" means Plant Expressed Peptide.

"Peptide expression cassette", or "expression cassette" means a DNA sequence which is composed of all the DNA elements necessary to complete transcription of an insecticidal peptide in a biological expression system. In the described methods herein, it includes a transcription promoter, a DNA sequence to encode an α-mating factor signal sequence and a Kex 2 cleavage site, an insecticidal peptide transgene, a stop codon and a transcription terminator.

"Peptide expression vector" means a host organism expression vector which contains a heterologous insecticidal peptide transgene.

"Peptide expression yeast strain", "peptide expression strain" or "peptide production strain" means a yeast strain which can produce a heterologous insecticidal peptide.

"Peptide made special" means a peptide previously having low peptide yield from a biological expression system that becomes an HP peptide because of the methods described herein used to increase its yield.

"Peptide transgene" or "insecticidal peptide transgene" means a DNA sequence that encodes an insecticidal peptide and can be translated in a biological expression system.

"Peptide yield" means the insecticidal peptide concentration in the conditioned medium which is produced from the cells of a peptide expression yeast strain. It can be represented by the mass of the produced peptide in a unit of volume, for example, mg per liter or mg/L, or by the UV absorbance peak area of the produced peptide in the HPLC chromatograph, for example, mAu·sec.

"Peritrophic membrane" means a lining inside the insect gut that traps large food particles can aid in their movement through the gut while allowing digestion, but also protecting the gut wall.

"PFIP" means a protein that can form a pore or channel in the cells that line an insect gut, such as gut epithelium cells. Examples of PFIPS are Bt proteins such as cry, crt and VIP other PFIP examples can be found in the sequence listing.

"PIP" or "Plant-incorporated protectant" means an insecticidal protein produced by transgenic plants, and the genetic material necessary for the plant to produce the protein.

"Plant cleavable linker" means a cleavable linker peptide, or a nucleotide encoding a cleavable linker peptide, which contains a plant protease recognition site and can be cleaved during the protein expression process in the plant cell.

"Plant regeneration media" means any media that contains the necessary elements and vitamins for plant growth and plant hormones necessary to promote regeneration of a cell into an embryo which can germinate and generate a plantlet derived from tissue culture. Often the media contains a selectable agent to which the transgenic cells express a selection gene that confers resistance to the agent.

"Plant transgenic protein" means a protein from a heterologous species that is expressed in a plant after the DNA or RNA encoding it was delivered into one or more of the plant cells.

"Polar amino acid" is an amino acid that is polar and includes serine, threonine, cysteine, asparagine, glutamine, histidine, tryptophan and tyrosine: preferred polar amino acids are serine, threonine, cysteine, asparagine and glutamine: with serine being most highly preferred.

"Post-transcriptional gene silencing", or "PTGS", means a cellular process within living cells that suppress the expression of a gene.

"Protein" has the same meaning as "Peptide" in this document.

"Recombinant vector" means a DNA plasmid vector into which foreign DNA has been inserted.

"Selection gene" means a gene which confers an advantage for a genomically modified organism to grow under the selective pressure.

"STA", or "Translational stabilizing protein", or "stabilizing protein", or "fusion protein" means a protein with sufficient tertiary structure that it can accumulate in a cell without being targeted by the cellular process of protein degradation. The protein can be between 5 and 50aa (eg another ICK-motif protein), 50 to 250aa (GNA), 250 to 750aa (eg chitinase) and 750 to 1500aa (eg enhancin). The translational stabilizing protein is coded by a DNA sequence for a protein that is fused in frame with a sequence encoding an insecticidal protein in the ORF. The fusion protein can either be upstream or downstream of the Insecticidal protein and can have any intervening sequence between the two sequences as long as the intervening sequence does not result in a frame shift of either DNA sequence. The translational stabilizing protein can also have an activity which increases delivery of the ICK motif protein across the gut wall and into the hemolymph of the insect. Such a delivery can be achieve by actively trafficking the entire ORF across the gut wall, or by cleavage within the gut environment to separate the ICK motif protein while the translational stabilizing protein damages the peritrophic membrane and/or gut wall to increase diffusion of the ICK motif protein into the hemolymph.

"sta" means a nucleotide encoding a translational stabilizing protein.

"TMOF" "TMOF motif," or "TMOF proteins" means "trypsin modulating oostatic factor" protein sequences. Examples are provided in the sequence listing. Numerous examples and variants are provided herein. SEQ ID NO: 708 is the wild type TMOF sequence. Other non-limiting variants are provided in SEQ. ID. NO: s 709-721. Other examples would be known or could be created by one skilled in the art.

"TSP" or "total soluble protein" means the total amount of protein that can be extracted from a plant tissue sample and solubilized into the extraction buffer.

"Transgene" means a heterologous DNA sequence encoding a protein which is transformed into a plant.

"Transgenic host cell" means a cell which is transformed with a gene and has been selected for its transgenic status via an additional selection gene.

"Transgenic plant" means a plant that has been derived from a single cell that was transformed with foreign DNA such that every cell in the plant contains that transgene.

"Transient expression system" means an *Agrobacterium tumefaciens*-based system which delivers DNA encoding a disarmed plant virus into a plant cell where it is expressed. The plant virus has been engineered to express a protein of interest at high concentrations, up to 40% of the TSP. In the technical proof, there are two transient expression systems used, a TRBO and a FECT system and the plant cells are leaf tissue of a tobacco plant "*Nicotiana benthamiana.*"

"TRBO" means a transient plant expression system using Tobacco mosaic virus with removal of the viral coating protein gene.

"Trypsin cleavage" means an in vitro assay that uses the protease enzyme trypsin (which recognizes exposed lysine and arginine amino acid residues) to separate a cleavable linker at that cleavage site. It also means the act of the trypsin enzyme cleaving that site.

"U peptide," U protein" aka "U toxin," aka "native U," aka "U-ACTX-Hv1a." aka "native U-ACTX-Hv1a," as well as "Hybrid peptide," aka "hybrid toxin," aka "hybrid-ACTX-Hv1a," aka "native hybridACTX-Hv1a," all refer to a native protein or native toxin, that can be found in nature or is otherwise known, in the case of "U-ACTX-Hv1a," aka "native U-ACTX-Hv1a," the protein is a native spider toxin, that was first discovered from a spider with origins in the Australian Blue Mountains and is dual antagonist against insect voltage gated $Ca^{2+}$ channels and $K^+$ channels. The spider from which the toxin was discovered is known as the Australian Blue Mountains Funnel-web Spider, which has the scientific name *Hydronyche versuta*.

"U+2 peptide." "U+2 protein". "U+2 toxin." or "U+2." or "U+2-ACTX-Hv1a" all refer to either a toxin, which has an additional dipeptide operatively linked to the native peptide, and may refer to the spider toxin which is sometimes called the U peptide and other names noted above. The additional dipeptide that is operatively linked to the U peptide and thus indicated as "+2" or "plus 2" can be selected among several peptides, any of which may result in a "U+2 peptide" with unique properties as discussed herein. These are also sometimes called "high production peptides." When the term "U+2-ACTX-Hv1a" is used, it refers to a specific high production toxic peptide, comprising a naturally occurring peptide from the Australian Blue Mountains Funnel-web Spider, which has the scientific name *Hydronyche versuta*.

"VIP" proteins were discovered from screening the supernatant of vegetatively gown strains of Bt for possible insecticidal activity. They have little or no similarity to cry proteins and they were named Vegetative Insecticidal Proteins or VIP. Of particular use and preference for use with this document are what have been called VIP3. Vip3 proteins or Vip toxins which have Lepidopteran activity. They are thought to have a similar mode of action as Bt cry peptides. In this document VIP proteins are categorized as a PFIP type of protein.

"Yeast expression vector." or "expression vector", or "vector." means a plasmid which can introduce a heterologous gene and/or expression cassette into yeast cells to be transcribed and translated.

"Yield" refers to the production of a peptide, and increased yields can mean increased amounts of production, increased rates of production, and an increased average or median yield and increased frequency at higher yields.

Section 1. Plant Incorporated Peptides or Plant Expressed Peptides "PIPS" AND PEPS"

Plant-incorporated protectants, or "PIPs", have presented one solution to the insect pressure faced by farmers. Modern agriculture employs genes from the *Bacillus thuringiensis* expressed as plant transgenic proteins to act as PIPs, but natural resistant insect strains have been detected in the field and threaten this class. Additional PIPs with novel modes of action need to be developed to manage the development of resistance. A novel class of proteins with insecticidal activity having the potential to become PIPs, are called Cysteine Rich Insecticidal Proteins (CRIPS) these proteins have 4, 6 or 8 cysteines and 2, 3 or 4 disulfide bonds. One example of this class of compounds are said to be of the type called inhibitor cysteine knot (ICK) motif protein. ICK motif proteins that have insecticidal activity have potential to be insecticidal proteins and PIPs.

ICK motif proteins are a class of proteins with at least six cysteine residues that form a specific ICK tertiary structure. Covalent cross-linking of the cysteine residues in the ICK motif proteins form disulfide bridges that result in a tertiary structures that makes the protein relatively resistant to proteases and sometimes to extreme physical conditions (pH, temperature. UV light, etc.), and confers activity against ion channels, which might specific to insects. Many ICK motif proteins have evolved in the venom of invertebrates and vertebrates that use the ICK motif proteins as a toxin to immobilize or kill their predators or prey. Such insecticidal peptides often have scorpion, spider and sometimes snake origins. In nature, toxic peptides can be directed to the insect's gut or to internal organs by injection. In the case of a PIP, the delivery is usually via the insect's consumption of transgenic protein expressed in plant tissue. Upon this consumption of the toxin from its food, for example an insect feeding upon a transgenic plant, the ICK motif protein may have the ability to inhibit the growth, impair the movement, or even kill an insect.

Toxic peptides however often lose their toxicity when they are expressed in plants. Unless the ICK motif protein is expressed as a properly folded protein it cannot successfully protect a plant or crop from insect damage. In some cases a plant expressed peptide will need to be activated by cleavage within the insect or during expression process in a plant in order to be active. There is a need for methods and modified peptides and nucleic acids that enable peptides to not only be expressed in a plant but to be expressed, folded properly and in some cases cleaved properly such that the peptide retains its activity against an insect even after expression in a plant. In this section we present several ways to produce active peptides adapted for expression in plants.

We describe various combinations of different peptides operably linked together to make novel protein complexes. The following protein complexes are described. A peptide comprised of an Endoplasmic Reticulum Signal Peptide (ERSP) operably linked to Cysteine Rich Insecticidal Peptide (CRIP) such as an Inhibitor Cystine Knot (ICK) motif protein, which is designated as ERSP-ICK, wherein said ERSP is the N-terminal of said peptide, and where the ERSP peptide is between 3 to 60 amino acids in length, between 5 to 50 amino acids in length, between 20 to 30 amino acids in length and or where the peptide is BAAS, or tobacco extensin signal peptide, or a modified tobacco extensin signal peptide, or Jun a 3 signal peptide of *Juniperus ashei* or *J ashei*.

A peptide comprised of an Endoplasmic Reticulum Signal Peptide (ERSP) operably linked to a Cysteine Rich Insecticidal Peptide (CRIP) such as an Inhibitor Cystine knot (ICK) motif protein, which is designated as ERSP-ICK, wherein the ICK motif protein is between 16 and 60 amino acids in length, between 26 and 48 amino acids in length, between 30 and 44 amino acids in length and or where the ICK motif protein is U-ACTX-Hv1a, or Omega-ACTX-Hv1a, or Kappa-ACTX-Hv1c.

A peptide comprised of an Endoplasmic Reticulum Signal Peptide (ERSP) operably linked to an Inhibitor Cystine Knot (ICK) motif protein, designated as ERSP-ICK, wherein said ERSP and Inhibitor Cystine Knot (ICK) motif protein are combinations of any of the sizes and lengths described herein and/or are comprised of any of the identified sequences taught in this document.

A nucleotide that codes for any of the peptides that are described herein as Endoplasmic Reticulum Signal Peptides (ERSP) and/or Cysteine Rich Insecticidal Peptide (CRIP) such as an Inhibitor Cystine Knot (ICK) motif proteins. An expression ORF comprising any of the nucleotides that code for these peptides. An expression ORF comprising any of the nucleotides that code for these peptides transformed into a transgenic plant genome. A peptide wherein said ICK motif protein is an insecticidal protein. A peptide wherein said insecticidal peptide is any of the ICK motif proteins or peptide described herein. A peptide wherein said insecticidal peptide is any peptide selected from any of the peptides or sources of peptides including *Atrax* or *Hadronyche*. An insecticidal peptide selected from any of the peptides in the Sequence Listing and fragments thereof including mature, pre, and pro peptide versions of said peptides and sequence numbers. A peptide wherein said insecticidal peptide is any peptide selected described or selected from an ACTX protein. A TMOF protein.

The use of any of the peptides or nucleotides described herein to make or transform a plant or plant genome in order to express properly folded toxic peptides in a transformed plant. The use of any of the peptides or nucleotides described herein to make or transform a plant or plant genome in order to express properly folded toxic peptides in the transformed plant and to cause the accumulation of the expressed and properly folded toxic peptides in said plant and to cause an increase the plant's resistance to insect damage.

A method of using the nucleotides of any of the peptides or expression ORFs in a CRIP, an ICK a Non-ICK, motif protein expression vectors to create transgenic plants. An ICK motif protein expression vector comprising any of the nucleotides which express any peptides described herein. An ICK motif protein expression vector incorporated into a transformed plant, comprising nucleotides that code for any of the peptides disclosed herein or that could be made by one skilled in the art given the teaching disclosed herein. A procedure for the generation of transformed plants having or expressing any of the peptides described herein. A plant made by any of the products and processes described herein.

A protein comprised of an Endoplasmic Reticulum Signal Peptide (ERSP) operably linked to an Inhibitor Cystine Knot (ICK) motif protein or cysteine rich peptide, operably linked to an intervening linker peptide (L or Linker), which is designated as ERSP-Linker-ICK. (ERSP-L-ICK), or ERSP-ICK-Linker (ERSP-ICK-L), wherein said ERSP is the N-terminal of said protein and said L or Linker, may be either on the N-terminal side (upstream) of the ICK motif protein or the C-terminal side (downstream) of the ICK motif protein. A protein designated as ERSP-L-ICK, or ERSP-ICK-L, comprising any of the ERSPs or ICK motif proteins described herein and wherein said L can be an uncleavable linker peptide, or a cleavable linker peptide, which may be cleavable in a plant cells during protein expression process or may be cleavable in an insect gut environments and hemolymph environments, and comprised of any of the intervening linker peptide (LINKER) described, or taught by this document including the following sequences: IGER (SEQ ID NO. 1) EEKKN. (SEQ ID NO. 2) and ETMFKHGL (SEQ ID NO. 3).

A nucleotide that codes for any of the peptides described as Endoplasmic Reticulum Signal Peptide (ERSP). Inhibitor Cystine knot (ICK) motif protein and or intervening linker peptide (LINKER) and any and all nucleotides that code for any of these proteins that are used to create transgenic plants.

The use of any of the peptides or nucleotides that code for Endoplasmic Reticulum Signal Peptide (ERSP). Inhibitor Cystine knot (ICK) motif protein and/or intervening linker peptide (LINKER) to make or transform a plant or plant genome in order to express properly folded toxic peptides in a transformed plant. The use of any of the peptides or nucleotides that code for Endoplasmic Reticulum Signal Peptide (ERSP). Inhibitor Cystine knot (ICK) motif protein and/or intervening linker peptide to make or transform a plant or plant genome in order to express properly folded toxic peptides in the transformed plant and to cause the accumulation of the expressed and properly folded toxic peptides in said plant and to cause an increase the plant's resistance to insect damage.

A method of using the nucleotides or expression ORFs that code for Endoplasmic Reticulum Signal Peptide (ERSP). Inhibitor Cystine Knot (ICK) motif protein and/or intervening linker peptide (LINKER) to create transgenic plants. An expression ORF comprising any of the nucleotides which are in an ICK expression vector express any peptides described herein. ERSP. ICK motif protein and/or LINKER. A functional expression ORF in an ICK motif protein expression vector incorporated into a transformed plant, comprising nucleotides that code for any of the peptides disclosed herein that code for ERSP. ICK motif protein and/or LINKER or that could be made by one skilled in the art given the teaching disclosed herein. A procedure for the generation of transformed plants having or expressing any of the peptides described herein. ERSP. ICK motif protein and/or LINKER. A plant made by any of the products and processes described herein.

A protein comprised of an Endoplasmic Reticulum Signal Peptide (ERSP) operably linked to an Inhibitor Cystine knot (ICK) motif protein operably linked to a Translational Stabilizing Protein (STA), which is designated as ERSP-STA-ICK or ERSP-ICK-STA, wherein said ERSP is the N-terminal of said protein and said STA may be either on the N-terminal side (upstream) of the ICK motif protein of the C-terminal side (downstream) of the ICK motif protein. A protein designated as ERSP-STA-ICK or ERSP-ICK-STA, comprising any of the ERSPs or ICK motif proteins described herein and where STA is comprised of any of the translational stabilizing proteins described, or taught by this document including GFP (Green Fluoresecnt Protein). GNA (snowdrop lectin). Jun a 3. (*Juniperus ashei*) and many other ICK motif proteins.

A nucleotide that codes for any of the peptides described as Endoplasmic Reticulum Signal Peptide (ERSP). Inhibitor Cystine Knot (ICK) motif protein and/or Translational Stabilizing Protein (STA) and any and all nucleotides having any of these functional groups that code for any of these proteins that are used to create transgenic plants.

The use of any of the peptides or nucleotides that code for Endoplasmic Reticulum Signal Peptide (ERSP). Inhibitor Cystine Knot (ICK) motif protein and/or Translational Stabilizing Protein (STA) to make or transform a plant or plant genome in order to express properly folded toxic peptides in a transformed plant. The use of any of the peptides or nucleotides that code for Endoplasmic Reticulum Signal Peptide (ERSP). Inhibitor Cystine Knot (ICK) motif protein and/or Translational Stabilizing Protein (STA) to make or transform a plant or plant genome in order to express properly folded toxic peptides in the transformed plant and to cause the accumulation of the expressed and properly folded toxic peptides in said plant and to cause an increase the plant's resistance to insect damage.

A method of using the nucleotides or expression ORFs that code for Endoplasmic Reticulum Signal Peptide (ERSP). Inhibitor Cystine knot (ICK) motif protein and/or Translational Stabilizing Protein (STA) in an ICK expression vector to create transgenic plants. An expression ORF comprising any of the nucleotides which express ERSP. ICK motif protein and/or STA. A functional expression ORF in a ICK motif protein expression vector that is incorporated into a transformed plant, comprising nucleotides that code for that code for ERSP. ICK motif protein and/or STA or that could be made by one skilled in the art given the teaching disclosed herein. A procedure for the generation of transformed plants having or expressing ERSP. ICK motif protein and/or STA. A plant made by any of the products and processes described herein.

A protein comprised of an Endoplasmic Reticulum Signal Peptide (ERSP) operably linked to an Inhibitor Cystine Knot (ICK) motif protein operably linked to a Translational Stabilizing Protein (STA) operably linked to an Intervening Linker Peptide (LINKER) which is designated as ERSP-STA-LINKER-ICK. ERSP-ICK-LINKER-STA. ERSP-STA-L-ICK or ERSP-ICK-L-STA, wherein said ERSP is the N-terminal of said protein and said STA may be either on the N-terminal side (upstream) of the ICK motif protein of the C-terminal side (downstream) of the ICK motif protein and said LINKER is between STA and the ICK motif protein. A protein designated as ERSP-STA-LINKER-ICK or ERSP-ICK-LINKER-STA, comprising any of the ERSPs. ICK motif proteins. Intervening Linker Peptides and Translational Stabilizing Proteins described herein.

A nucleotide that codes for any of the peptides described as Endoplasmic Reticulum Signal Peptide (ERSP). Inhibitor Cystine Knot (ICK) motif protein. Intervening Linker Peptide (LINKER) and/or Translational Stabilizing Protein (STA) and any and all nucleotides that code for any of these proteins that are used to create transgenic plants.

The use of any of the peptides or nucleotides that code for Endoplasmic Reticulum Signal Peptide (ERSP), Inhibitor Cystine Knot (ICK) motif protein. Intervening Linker Peptide and/or Translational Stabilizing Protein (STA) to make or transform a plant or plant genome in order to express properly folded toxic peptides in a transformed plant. The use of any of the peptides or nucleotides that code for Endoplasmic Reticulum Signal Peptide (ERSP). Inhibitor Cystine Knot (ICK) motif protein. Intervening Linker Peptide (LINKER) and/or Translational Stabilizing Protein (STA) to make or transform a plant or plant genome in order to express properly folded toxic peptides in the transformed plant and to cause the accumulation of the expressed and properly folded toxic peptides in said plant and to cause an increase the plant's resistance to insect damage.

A method of using the nucleotides or expression ORFs in an ICK expression vector that code for Endoplasmic Reticulum Signal Peptide (ERSP). Inhibitor Cystine Knot (ICK) motif protein. Intervening Linker Peptide and/or Translational Stabilizing Protein (STA) to create transgenic plants. An expression ORF comprising any of the nucleotides in an ICK expression vector which express ERSP. ICK motif protein. LINKER and/or STA. A functional expression ORF in an ICK expression vector incorporated into a transformed plant, comprising nucleotides that code for that code for ERSP. ICK motif protein. LINKER and/or STA or that could be made by one skilled in the art given the teaching disclosed herein. A procedure for the generation of transformed plants having or expressing ERSP. ICK motif protein. LINKER and/or STA. A plant made by any of the products and processes described herein.

A protein comprised of an Endoplasmic Reticulum Signal Peptide (ERSP) operably linked to multiple Inhibitor Cystine Knot (ICK) motif protein domain, which are operably linked by Intervening Linker Peptides (LINKER), operably linked to a Translational Stabilizing Protein (STA) operably linked to an Intervening Linker Peptide, which is designated as ERSP-STA-(LINKER$_i$-ICK$_j$)$_N$ or ERSP-(ICK$_j$-LINKER$_i$)$_N$-STA and sometimes as ERSP-STA-(L$_i$-ICK$_j$)$_N$ or ERSP-(ICK$_j$-L$_i$)$_N$-STA, wherein said ERSP is the N-terminal of said protein and said STA may be either on the N-terminal side (upstream) of the multiple ICK motif protein domain ((LINKER$_i$-ICK$_j$)$_N$) or the C-terminal side (downstream) of the multiple ICK motif protein domain ((ICK$_j$-LINKER$_i$)$_N$) and said multiple Intervening Peptides (LINKER$_i$) is between STA and the multiple ICK motif protein domain and between the ICK motif proteins in the multiple ICK motif protein domain. A protein designated as ERSP-STA-(LINKER$_i$-ICK$_j$)$_N$ or ERSP-(ICK$_j$-LINKER$_i$)$_N$-STA, comprising any of the ERSPs, ICK motif proteins, Intervening Linker Peptides and Translational Stabilizing Proteins described herein.

A nucleotide that codes for any of the peptides described as Endoplasmic Reticulum Signal Peptide (ERSP), multiple Inhibitor Cystine Knot (ICK) motif protein domain, Intervening Linker Peptide (LINKER) and/or Translational Stabilizing Protein (STA) and any and all nucleotides that code for any of these proteins that are used to create transgenic plants.

The use of any of the peptides or nucleotides that code for Endoplasmic Reticulum Signal Peptide (ERSP), multiple Inhibitor Cystine Knot (ICK) motif protein domain, Intervening Linker Peptide, (LINKER) and/or Translational Stabilizing Protein (STA) to make or transform a plant or plant genome in order to express properly folded toxic peptides in a transformed plant. The use of any of the peptides or nucleotides that code for Endoplasmic Reticulum Signal Peptide (ERSP), multiple Inhibitor Cystine Knot (ICK) motif protein domain, Intervening Linker Peptide (LINKER) and/or Translational Stabilizing Protein (STA) to make or transform a plant or plant genome in order to express properly folded toxic peptides in the transformed plant and to cause the accumulation of the expressed and properly folded toxic peptides in said plant and to cause an increase the plant's resistance to insect damage.

A method of using the nucleotides or expression ORFs that code for Endoplasmic Reticulum Signal Peptide (ERSP), multiple Inhibitor Cystine Knot (ICK) motif protein domain, Intervening Linker Peptide (LINKER) and/or Translational Stabilizing Protein (STA) to create transgenic plants. An expression ORF comprising any of the nucleotides which express ERSP, multiple ICK motif protein domain, L or LINKER and/or STA. A functional expression ORF incorporated into a transformed plant, comprising nucleotides that code for ERSP, multiple ICK motif protein domain, LINKER and/or STA or that could be made by one skilled in the art given the teaching disclosed herein. A procedure for the generation of transformed plants having or expressing ERSP, multiple ICK motif protein domain, LINKER and/or STA. A plant made by any of the products and processes described herein.

A chimeric gene comprising a promoter active in plants operatively linked to the nucleic acids or expression ORF of the nucleotides described herein. A method of making, producing or using these chimeric genes that are described herein. A recombinant vector comprising the chimeric genes described herein. A method of making, producing or using the recombinant vectors described herein. A transgenic host cell comprising the chimeric genes described herein. A method of making, producing or using the transgenic host cell described herein. A transgenic host cell as described herein which is a transgenic plant cell. A method of making, producing or using the transgenic plant cell described herein. A transgenic plant comprising the transgenic plant cell described herein. A method of making, producing or using the transgenic plants described herein. A transgenic plant as described herein which made from a corn, soybean, cotton, rice, wheat, sorghum, switchgrass, sugarcane, alfalfa, potatoes, tomatoes, tobacco, any of green leafy vegetables, or any of fruit trees. Seed from a transgenic plant as described herein wherein said seed comprises a chimeric gene as described herein. A method of making, producing or using the transgenic plant described herein. A method of making, producing or using the seeds described herein.

Plant expressed inhibitory cysteine knot (ICK) motif proteins from spiders and scorpions have been described (Khan et al, Transgenic Res., 2006, 15: 349-357; Hemindez-Campuzano et al, Toxicon. 2009 January; 53(1):122-8). We describe how to make plant expressed ICK motif proteins that are active and accumulate in plants to insecticidal dose levels. We show that prior descriptions of plant expressed ICK motif proteins were actually descriptions of inactive proteins that had lost their natural toxicity. We describe methods to increase the efficacy of the plant expression, to increase the accumulation of plant expressed proteins and to dramatically increase the insecticidal activity of plant expressed proteins. We describe how to induce the plant expressed ICK motif proteins to enter the Endoplasmic Reticulum (ER) directed by an Endoplasmic Reticulum Signaling Protein (ERSP) in plant cells, in order for the correct covalent cross-linking of peptide disulfide bridges which generate the essential tertiary ICK motif structure required for insecticidal activity. We further describe the plant expressed, ER-trafficking ICK motif protein complex with a translational stabilizing protein domain (STA) added in order to increase the size of the resulting ICK fusion protein which enhances peptide accumulation in the plant. We further describe the plant expressed, ER-trafficking ICK motif protein, with a translational stabilizing protein added as above, and with an intervening linker peptide (LINKER) added, the latter of which may allow for potential cleavage and the recovery of the active form of the ICK motif protein having insecticidal activity. We further describe the plant expressed polypeptide, which contains ER-trafficking ICK motif protein domain with multiple ICK motif proteins separated by intervening linker peptides (LINKER), with an intervening linker peptide added, with a translation stabilizing protein added, latter of which allows the correctly folded ICK motif protein to accumulate in the plant to the insecticidal dose.

This invention describes the ICK motif protein with insecticidal activity that are plant expressed and which can successfully protect a plant or crop from insect damage. The ICK motif protein expression ORF described herein is a nucleotide which will enable the plant translated peptides to not only be expressed in a plant but also to be expressed and folded properly, and to be accumulated to the insecticidal dose in the plant. An example of a protein expression ORF can be an ICK motif protein expression ORF which is can be described below in equation style and is shown in diagram style in the drawings or figures.

ersp-sta-(linker$_i$-crip$_j$)$_N$, or ersp-(crip$_j$-linker$_i$)$_N$-sta

The expression above is merely one example, and similar expressions could be written for other types of CRIP expression ORFs, for example an ICK expression ORF, could be written as:

ersp-sta-(linker$_i$-ick$_j$)$_N$, or ersp-(ick$_j$-linker$_i$)$_N$-sta

These expressions, equations or linear diagrams describe a polynucleotide open reading frame (ORF) for one type of CRIP, one which expresses the ICK motif protein complex, which can be described as ERSP-STA-(LINKER$_I$-ICK)$_N$ or ERSP-(ICK$_J$-LINKER$_I$)$_N$-STA, or as ERSP-STA-(L$_1$-ICK$_J$)$_N$ or ERSP-(ICK$_J$-L$_1$)$_N$-STA, containing four possible peptide components with dash signs to separate each component. In the diagrams above, the nucleotide component of ersp is a polynucleotide segment encoding a plant endoplasmic reticulum trafficking signal peptide (ERSP). The component of sta is a polynucleotide segment encoding a translation stabilizing protein (STA), which helps the accumulation of the ICK motif protein expressed in plants but may not be necessary in the ICK motif protein expression ORF. The component of linker$_i$ is a polynucleotide segment encoding an intervening linker peptide (L OR LINKER) to separate the ICK motif proteins from each other and from the translation stabilizing protein, and the subscription "i" indicates that different types of linker peptides can be used in the CRIP or ICK motif protein expression ORF. In the case that sta is not used in the ICK motif protein expression ORF, ersp can directly be linked to the polynucleotide encoding an ICK motif protein without a linker. The component of ick$_i$ is a polynucleotide segment encoding an ICK motif protein (ICK), and the subscription "j" indicates different ICK motif proteins; "(linker$_i$-ick$_j$)$_N$" indicates that the structure of the nucleotide encoding an intervening linker peptide and an ICK motif protein can be repeated "N" times in the same open reading frame in the same ICK motif protein expression ORF, where N can be any integrate number from 1 to 10. N can be from 1 to 10, specifically N can be 1, 2, 3, 4, or 5, and in some embodiments N is 6, 7, 8, 9 or 10. The repeats may contain polynucleotide segments encoding different intervening linkers (LINKER) and different ICK motif proteins. The different polynucleotide segments including the repeats within the same ICK motif protein expression ORF are all within the same translation frame.

Any combination of the four principal components, ersp, sta, linker and crip or ick as in the diagram of the ICK motif protein expression ORF, may be used to create a PEP type ICK motif protein expression ORF as long as a minimum of ersp and at least one copy of crip or ick are used.

I. The ERSP or Ersp Component of the PEPs.

The ICK motif protein expression ORF starts with an ersp at its 5' terminus. For the ICK motif protein to be properly folded and functional when it is expressed from a transgenic plant, it must have an ersp nucleotide fused in frame with the polynucleotide encoding an ICK motif protein. During cellular translation process, translated ERSP can direct the ICK motif protein being translated to insert into the Endoplasmic Reticulum (ER) of the plant cell by binding with a cellular component called a signal-recognition particle. Within the ER the ERSP peptide is cleaved by signal peptidase and the ICK motif protein is released into the ER, where the ICK motif protein is properly folded during the post-translation modification process, for example, the formation of disulfide bonds. Without any additional retention protein signals, the protein is transported through the ER to the Golgi apparatus, where it is finally secreted outside the plasma membrane and into the apoplastic space. ICK motif protein can accumulate at apoplastic space efficiently to reach the insecticidal dose in plants. FIG. 1 shows a representative diagram of a simple two component peptide or nucleotide composed of an ERSP functionally linked to an ICK motif. The ICK could be a suitable CRIP. More complex proteins and polynucleotides utilizing ERSP are diagrammed in FIGS. 2-5 and these figures are further discussed in the discussion of the STA or Translational Stabilizing Protein.

The ERSP peptide is at the N-terminal region of the plant translated ICK motif protein complex and the ERSP portion is composed of about 3 to 60 amino acids. In some embodiments it is 5 to 50 amino acids. In some embodiments it is 10 to 40 amino acids but most often is composed of 15 to 20; 20 to 25; or 25 to 30 amino acids. The ERSP is a signal peptide so called because it directs the transportation of a protein. Signal peptides may also be called targeting signals, signal sequences, transit peptides, or localization signals. The signal peptides for ER trafficking are often 15 to 30 amino acid residues in length and have a tripartite organization, comprised of a core of hydrophobic residues flanked by a positively charged aminoterminal and a polar, but uncharged carboxyterminal region. (Zimmermann, et al, "Protein translocation across the ER membrane", *Biochimica et Biohysica Acta,* 2011, 1808: 912-924).

Many ERSPs are known. Many plant ERSPs are known. It is NOT required that the ERSP be derived from a plant ERSP, non-plant ERSPs will work with the procedures described herein. Many plant ERSPs are however well known and we describe some plant derived ERSPs here. BAAS, for example, is derived from the plant, *Hordeum vulgare*, and has the amino acid sequence as follows:

(SEQ ID NO: 4)
MANKHLSLSLFLVLLGLSASLASG

Plant ERSPs, which are selected from the genomic sequence for proteins that are known to be expressed and released into the apoplastic space of plants, and a few examples are BAAS, carrot extensin, tobacco PR1. The following references provide further descriptions, and are incorporated by reference herein in their entirety. De Loose, M. et al. "The extensin signal peptide allows secretion of a heterologous protein from protoplasts" Gene, 99 (1991) 95-100. De Loose, M. et al. described the structural analysis of an extensin—encoding gene from *Nicotiana plumbaginifolia*, the sequence of which contains a typical signal peptide for translocation of the protein to the endoplasmic reticulum. Chen, M. H. et al. "Signal peptide-dependent targeting of a rice alpha-amylase and cargo proteins to plastids and extracellular compartments of plant cells" *Plant Physiology,* 2004 July; 135(3): 1367-77. Epub 2004 Jul. 2. Chen, M. H. et al. studied the subcellular localization of α-amylases in plant cells by analyzing the expression of α-amylase, with and without its signal peptide, in transgenic tobacco. These references and others teach and disclose the signal peptide that can be used in the methods, procedures and peptide, protein and nucleotide complexes and constructs described herein.

II. The CRIP and ICK Motif Protein Component or Crip and Ick of the PEPs.

In our ICK motif protein expression ORF diagram, "ick" means a polynucleotide encoding an "ICK motif protein," or "inhibitor cystine knot motif protein", which is a 16 to 60 amino acid peptide with at least 6 half-cysteine core amino acids having three disulfide bridges, wherein the 3 disulfide bridges are covalent bonds and of the six half-cystine residues the covalent disulfide bonds are between the first and fourth, the second and fifth, and the third and sixth half-cystines, of the six core half-cystine amino acids starting from the N-terminal amino acid. The ICK motif protein also comprises a beta-hairpin secondary structure, normally composed of residues situated between the fourth and sixth core half-cysteines of the motif, the hairpin being stabilized by the structural crosslinking provided by the motif's three disulfide bonds. Note that additional cysteine/cysteine or half-cystine amino acids may be present within the inhibitor cysteine knot motif, as shown in FIG. 6. The CRIP or ICK motif can be repeated in order to increase toxic peptide accumulation in the plant. See FIG. 4 and FIG. 5. This ability to repeat the CRIP or ICK motif, from 1 to 10 times and sometimes up to 15, 20 or 25 times is also shown in the equation like diagram of a CRIP or ICK protein expression ORF described herein as ersp-sta-$(\text{linker}_i\text{-ick}_j)_N$, or ersp-$(\text{ick}_j\text{-linker}_i)_N$-sta where the number of repeating LINKER-ICK motifs is given by the subscript number N and N is commonly 1-10 but can go even higher in some plants.

A similar expression like ersp-sta-$(\text{linker}_i\text{-ick}_j)_N$, or ersp-$(\text{ick}_j\text{-linker}_i)_N$-sta could be written and would describe other CRIP peptides. In this section an example of one expression ORF is one used to increase peptide expression in plants and is best exemplified with an ICK protein. In the diagram above, a polynucleotide open reading frame (ORF) which expresses an ICK motif protein complex, which can be described as ERSP-STA-$(\text{LINKER}_I\text{-ICK}_J)_N$ or ERSP-$(\text{ICK}_J\text{-LINKER}_I)_N$-STA, or as ERSP-STA-$(\text{L}_1\text{-ICK}_J)_N$ or ERSP-$(\text{ICK}_J\text{-L}_1)_N$-STA, containing four possible peptide components with dash signs to separate the each component is used. An alternate method of showing this type of construct can be found in the figures. In the diagram and the figures, the nucleotide component of ersp is a polynucleotide segment encoding a plant endoplasmic reticulum trafficking signal peptide (ERSP). The component of sta is a polynucleotide segment encoding a translation stabilizing protein (STA), which helps the accumulation of the ICK motif protein expressed in plants but may not be necessary in the ICK motif protein expression ORE. The component of $l_i$ is a polynucleotide segment encoding an intervening linker peptide (L OR LINKER) to separate the ICK motif proteins from each other and from the translation stabilizing protein, and the subscription "i" indicates that different types of linker peptides can be used in the ICK motif protein expression ORF. In the case that sta is not used in the ICK motif protein expression ORF, ersp can directly be linked to the polynucleotide encoding an ICK motif protein without a linker. The component of $ick_j$ is a polynucleotide segment encoding an ICK motif protein (ICK), and the subscription "j" indicates different ICK motif proteins; $(linker_i\text{-}ick_j)_N$" indicates that the structure of the nucleotide encoding an intervening linker peptide and an ICK motif protein can be repeated "N" times in the same open reading frame in the same ICK motif protein expression ORF, where N can be any integrate number from 1 to 10, but can go even higher to 15, 20 and 25, these repeats may contain polynucleotide segments encoding different intervening linkers and different ICK or CRIP motif proteins. The different polynucleotide segments including the repeats within the same ICK or CRIP motif protein expression ORF are all within the same translation frame.

This motif is common in peptides isolated from the venom of numerous species. Invertebrate species include spiders, scorpions, cone snail, sea anemone etc., other examples are numerous, even snake venom has been known to have peptides having the ICK motif. An example within spiders that we used is from a class of ACTX peptides from the Australian Blue Mountains Funnel-web Spider, but the procedures described herein are useful and may be applied to any protein with the ICK motif.

Examples of peptide toxins with the ICK motif can be found in the following references. The N-type calcium channel blocker ω-Conotoxin was reviewed by Lew, M. J. et al. "Structure-Function Relationships of ω-Conotoxin GVIA" *Journal of Biological Chemistry*, Vol. 272, No. 18, Issue of May 2, pp. 12014-12023, 1997. A summary of numerous arthropod toxic peptides from different spider and scorpion species was reviewed in, Quintero-Hemandez, V. et al. "Scorpion and Spider Venom Peptides: Gene Cloning and Peptide Expression" *Toxicon*, 58, pp. 644-663, 2011. The three-dimensional structure of Hanatoxin1 using NMR spectroscopy was identified as an inhibitor cysteine knot motif in Takahashi, H. et al. "Solution structure of hanatoxin1, a gating modifier of voltage-dependent K+ channels: common surface features of gating modifier toxins" *Journal of Molecular Biology*, Volume 297, Issue 3, 31 Mar. 2000, pp. 771-780. The isolation and identification of cDNA encoding a scorpion venom ICK toxin peptide, Opicalcinel, was published by Zhu, S. et al. "Evolutionary origin of inhibitor cystine knot peptides" *FASEB J.*, 2003 Sep. 17, (12):1765-7, Epub 2003 Jul. 3. The sequence-specific assignment and the secondary structure identification of BgK, a K$^+$ channel-blocking toxin from the sea anemone *Bunodosoma granulifera*, was disclosed by Dauplais, M. et al. "On the convergent evolution of animal toxins" *Journal of Biological Chemistry*. 1997 Feb. 14; 272(7): 4302-9. A review of the composition and pharmacology of spider venoms with emphasis on polypeptide toxin structure, mode of action, and molecular evolution showing cysteine bridges, cysteine knot formations and the "knotting-type" fold was published by Escoubas, P. et al. "Structure and pharmacology of spider venom neurotoxins" *Biochimie*, Vol. 82, Issues 9-10, 10 Sep. 2000, pp. 893-907. The purified peptide, iberiotoxin, an inhibitor of the Ca$^{2+}$-activated K$^+$ channel, from scorpion (*Buthus tamulus*) venom was disclosed in Galvez, A. et al. "Purification and characterization of a unique, potent, peptidyl probe for the high conductance calcium-activated potassium channel from venom of the scorpion *Buthus tamulus*" *Journal of Biological Chemistry*, 1990 Jul. 5; 265(19): 11083-90. The purified peptide, charybdotoxin, an inhibitor of the Ca$^{2+}$-activated K$^+$ channel, from the venom of the scorpion *Leiurus quinquestriatus* was disclosed in Gimenez-Gallego, G. et al. "Purification, sequence, and model structure of charybdotoxin, a potent selective inhibitor of calcium-activated potassium channels" *Proc Natl Acad Sci*, 1988 May; 85(10): 3329-3333. From these and other publications, one skilled in the art should be able to readily identify proteins and peptides having what we describe as the ICK motif, ICK motif protein or the "inhibitor cystine knot motif."

Figure 6:
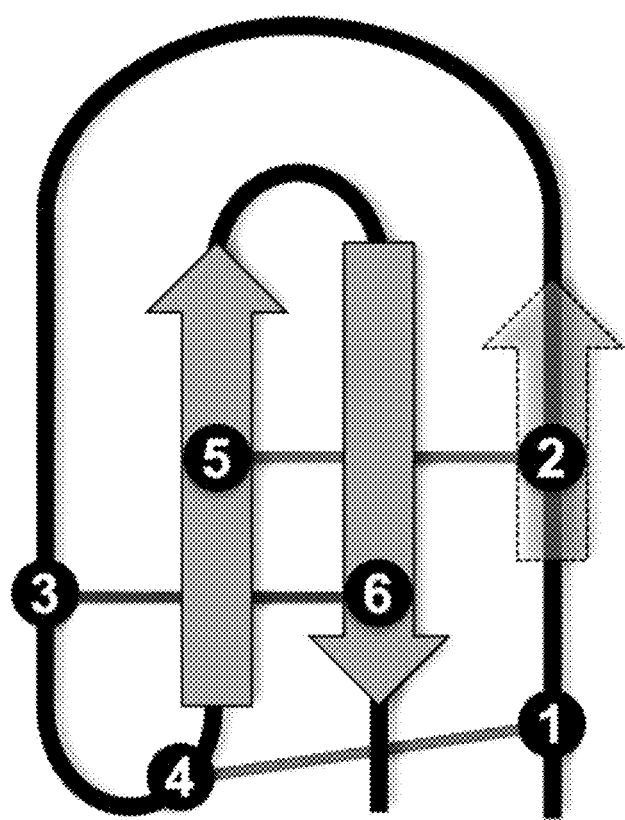
FIG. 6 is a diagram of a covalent cross-linking of the cysteines in an inhibitor cysteine knot (ICK) motif protein. The arrows in the diagram represent β sheets: the numbers represent the ICK motif-forming cystine amino acids, numbered in the order of their occurrence in the primary structure from N to C terminus. The thick curved line represents the primary structure of the protein: the thin straight lines represent the covalent cross-linking of the specific cysteines to create an ICK motif. Sometimes the β sheet encompassing cysteine number 2 is not present.

The ICK motif protein can be any protein with the ICK motif and is between 16 and 60 amino acids in length, with at least 6 cysteine residues that create covalent cross-linking disulfide bonds in the proper order. See FIG. 6. Some ICK motif peptides have between 26-60 amino acids in length. Some ICK motif proteins are between 16-48 amino acids in length. Some ICK motif proteins are between 26-48 amino acids in length. Some ICK motif proteins are between 30-44 amino acids in length. ICK motif proteins with natural insecticidal activity are preferred but ICK motif proteins with other types of activity such as salt and frost resistance are known to those skilled in the art and are claimed herein. Examples of insecticidal ICK motif proteins include the ACTX peptides and genes, and including all of the peptides and their coding genes known as Magi6.

An example of a protein expression ORF could be an ICK motif protein expression ORF diagrammed below as:
ersp-sta-$(linker_i\text{-}ick_j)_N$, or ersp-$(ick_j\text{-}linker)_N$-sta A similar expression could be written for other CRIP peptides. In this section this example of an expression ORF is one used to high peptide expression and is best exemplified with an ICK protein. The diagram above a polynucleotide open reading frame (ORF) which expresses an ICK motif protein complex, which can be described as ERSP-STA-$(LINKER_1\text{-}ICK_j)_N$ or ERSP-$(ICK_j\text{-}LINKER_l)_N$-STA, or as ERSP-STA-$(L_l\text{-}ICK_j)_N$ or ERSP-$(ICK_j\text{-}L_l)_N$-STA, containing four possible peptide components with dash signs to separate the each component, In this diagram, the nucleotide component of ersp is a polynucleotide segment encoding a plant endoplasmic reticulum trafficking signal peptide (ERSP). The component of sta is a polynucleotide segment encoding a translation stabilizing protein (STA), which helps the accumulation of the ICK motif protein expressed in plants but may not be necessary in the ICK motif protein expression ORF. The component of $l_i$ is a polynucleotide segment encoding an intervening linker peptide (L OR LINKER) to separate the ICK motif proteins from each other and from the translation stabilizing protein, and the subscription "i" indicates that different types of linker peptides can be used in the ICK motif protein expression ORF. In the case that sta is not used in the ICK motif protein expression ORF, ersp can directly be linked to the polynucleotide encoding an ICK motif protein without a linker. The component of $ick_j$ is a polynucleotide segment encoding an ICK motif protein (ICK), and the subscription "j" indicates different ICK motif proteins; $(linker_i\text{-}ick_j)_N$" indicates that the structure of the nucleotide encoding an intervening linker peptide and an ICK motif protein can be repeated "N" times in the same open reading frame in the same ICK motif protein expression ORF, where N can be any integrate number from 1 to 10, and the repeats may contain polynucleotide segments encoding different intervening linkers and different ICK or CRIP motif proteins. The different polynucleotide segments including the repeats within the same ICK or CRIP motif protein expression ORF are all within the same translation frame.

Examples of insecticidal ICK motif proteins include the ACTX peptides and genes and include all of the peptides and their coding genes as described in the references provided above and herein. Specific examples of ICK motif proteins and peptides disclosed for purposes of providing examples and not intended to be limiting in any way, are the peptides and their homologies as described above, and in particular peptides and nucleotides which originate from the venoms of Australian Funnel-web spiders. The following documents are incorporated by reference in the United States in their entirety, are known to one skilled in the art, and have all been published. They disclose numerous ICK motif proteins which, their full peptide sequence, their full nucleotide sequence, are specifically disclosed and are incorporated by reference, and in addition the full disclosures are incorporated by reference including all of their sequence listings. See the following: U.S. Pat. No. 7,354,993 B2, issued Apr. 8, 2008, specifically the peptide and nucleotide sequences listed there as sequences 1-39, from 7,354,993 B2, and those named U-ACTX polypeptides, and these and other toxins that can form 2 to 4 intra-chain disulfide bridges, and variants thereof, and the peptides appearing on columns 4 to 9 and in FIG. 2 of 7,354,993 B2. Other specific sequences can be found in EP patent 1 812 464 B1, published and granted 08.10.2008, see Bulletin 2008/41, specifically the peptide and nucleotide sequences listed in the sequence listing, and those the other toxins that can form 2 to 4 intra-chain disulfide bridges, and those sequences listed there as 1-39, and sequences named U-ACTX polypeptides, and variants thereof, and the peptides appearing in paragraphs 0023 to 0055, and appearing in FIG. 1 of EP patent 1 812 464 B1.

Described and incorporated by reference to the peptides identified herein are homologous variants of sequences mentioned, having homology to such sequences or referred to herein, which are also identified and claimed as suitable for making special according to the processes described herein, including all homologous sequences having at least any of the following percent identities to any of the sequences disclosed here or to any sequence incorporated by reference: 50%, 55%, 60%, 65%, 70%, 75%, 80%, 85%, 90%, 95%, 96%, 97%, 98%, or 99% or greater identity or 100% identity to any and all sequences identified in the patents noted above, and to any other sequence identified herein, including each and every sequence in the sequence listing of this application. When the term homologous or homology is used herein with a number such as 50% or greater, then what is meant is percent identity or percent similarity between the two peptides. When homologous or homology is used without a numeric percent then it refers to two peptide sequences that are closely related in the evolutionary or developmental aspect in that they share common physical and functional aspects, like topical toxicity and similar size (i.e., the homolog being within 100% greater length or 50% shorter length of the peptide specifically mentioned herein or identified by reference herein as above).

Described and incorporated by reference to the peptides identified herein are toxic peptides including the following: peptides and its variants found in, isolated from, or derived from spiders of the genus *Atrax* or *Hadronyche*, including the genus species, *Hadronyche versuta*, or the Blue Mountain funnel web spider, *Atrax robustus, Atrax formidabilis, Atrax infensus*, including toxins known as U-ACTX polypetides, U-ACTX-Hv1a, rU-ACTX-Hv1a, rU-ACTX-Hv1b, or mutants or variants, especially peptides of any of these types and especially those less than about 200 amino acids but greater than about 10 amino acids, and especially peptides less than about 150 amino acids but greater than about 20 amino acids, especially peptides less than about 100 amino acids but greater than about 25 amino acids, especially peptides less than about 65 amino acids but greater than about 25 amino acids, especially peptides less than about 55 amino acids but greater than about 25 amino acids, especially peptides of about 37 or 39 or about 36 to 42 amino acids, especially peptides with less than about 55 amino acids but greater than about 25 amino acids, especially peptides with less than about 45 amino acids but greater than about 35 amino acids, especially peptides with less than about 115 amino acids but greater than about 75 amino acids, especially peptides with less than about 105 amino acids but greater than about 85 amino acids, especially peptides with less than about 100 amino acids but greater than about 90 amino acids, including peptide toxins of any of the lengths mentioned here that can form 2, 3 and or 4 or more intrachain disulfide bridges, including toxins that disrupt calcium channel currents, including toxins that disrupt potassium channel currents, especially toxins that disrupt insect calcium channels or Us thereof, especially toxins or variants thereof of any of these types, and any combination of any of the types of toxins described herein that have oral or topical insecticidal activity, can be made special by the processes described herein.

The U peptides from the Australian Funnel Web Spider, genus *Atrax* and *Hadronyche* are particularly suitable and work well when treated by the methods, procedures or processes described by this invention. Examples of such suitable peptides tested and with data are provided herein. The following species are also specifically known to carry toxic peptides suitable for plant expression as PIPs by the process of this invention. The following species are specifically named: *Atrax formidabillis, Atrax infensus, Atrax robustus, Hadronyche infensa, Hadronyche versuta*. Any toxic peptides derived from any of the genus listed above and/or genus species and homologous to the U peptide are suitable for plant expression as PIPs according to the process in this invention.

The Examples in this specification are not intended to, and should not be used to limit the invention, they are provided only to illustrate the invention.

As noted above, many peptides are suitable candidates as the subject of the process for the plant expression as PIP. The sequences noted above, below and in the sequence listing are especially suitable peptides that can be expressed in plants as PIP, and some of these have been expressed in plants as PIP according to this invention with the results shown in the examples below.

(SEQ ID NO: 5)
GSQYC VPVDQ PCSLN TQPCC DDATC TQERN ENGHT VYYCR A

Named "U+2-ACTX-Hv1a," it has disulfide bridges at positions: 5-20, 12-25, 19-39. The molecular weight is 4564.85 Daltons. Another example of an ICK motif insecticidal protein:

(SEQ ID NO: 6)
QYCVP VDQPC SLNTQ PCCDD ATCTQ ERNEN GHTVYYCRA

Named "U-ACTX-Hv1a," it has disulfide bridges at positions: 3-18, 10-23, 17-37.

The molecular weight is 4426.84 Daltons.

Additional examples include many sequences in the sequence listing.

II. The Translational Stabilizing Protein Component, STA or Sta.

One of the ICK motif protein expression ORFs, ERSP-ICK, is sufficient to express a properly folded ICK motif peptide in the transformed plant, but in order for effective protection of a plant from pest damage, the plant expressed ICK motif protein needs to be accumulated to the insecticidal level. With transformation of a properly constructed ICK motif protein expression ORF, a transgenic plant can express and accumulate greater amounts of the correctly folded ICK motif protein. When a plant accumulates greater amounts of properly folded toxic peptides it can more easily resist or kill the insects that attack and eat the plants. The translational stabilizing protein can be used to significantly increase the accumulation of the toxic peptide in the plant and thus the potency of the PIP, especially when the PIP has a translational stabilizing protein of its own. See various representations of how the STA may be used in expression ORFs in FIGS. 2-5, and in various linear diagrams or equation like expressions used below. The translational stabilizing protein can be a domain of another protein or it can comprise an entire protein sequence. The translational stabilizing protein is a protein with sufficient tertiary structure that it can accumulate in a cell without being targeted by the cellular process of protein degradation. The protein can be between 5 and 50aa (e.g. another ICK-motif protein), 50 to 250aa (GNA), 250 to 750aa (e.g. chitinase) and 750 to 1500aa (e.g. enhancin).

In addition to FIGS. 2-5 the following linear diagram below describes one of the examples of the ICK motif protein expression ORF that encodes a stabilizing protein fused with ICK motif protein:

ersp-sta-l-ick

The protein, or protein domain can contain proteins that have no useful characteristics other than translation stabilization, or they can have other useful traits in addition to translational stabilization. Useful traits can include: additional insecticidal activity, such as activity that is destructive to the peritrophic membrane, activity that is destructive to the gut wall, and/or activity that actively transports the ICK motif protein across the gut wall. One embodiment of the translational stabilizing protein can be a polymer of fusion proteins involving ICK motif proteins. A specific example of a translational stabilizing protein is provided here to illustrate the use of a translational stabilizing protein. The example is not intended to limit the disclosure or claims in any way. Useful translational stabilizing proteins are well known in the art, and any proteins of this type could be used as disclosed herein. Procedures for evaluating and testing production of peptides are both known in the art and described herein. One example of one translational stabilizing protein is SEQ ID NO:7, one letter code, as follows:

```
                                     (SEQ ID NO: 7)
ASKGE ELFTG VVPIL VELDG DVNGH KFSVS GEGEG DATYG

KLTLK FICTT GKLPV PWPTL VTTFS YGVQC FSRYP DHMKR

HDFFK SAMPE GYVQE RTISF KDDGN YKTRA EVKFE GDTLV

NRIEL KGIDF KEDGN ILGHK LEYNY NSHNV YITAD KQKNG

IKANF KIRHN IEDGS VQLAD HYQQN TPIGD GPVLL PDNHY

LSTQS ALSKD PNEKR DHMVL LEFVT AAGIT HGMDE LYK
```

Named "GFP." The molecular weight is 26736.02 Daltons.

Figure 5:
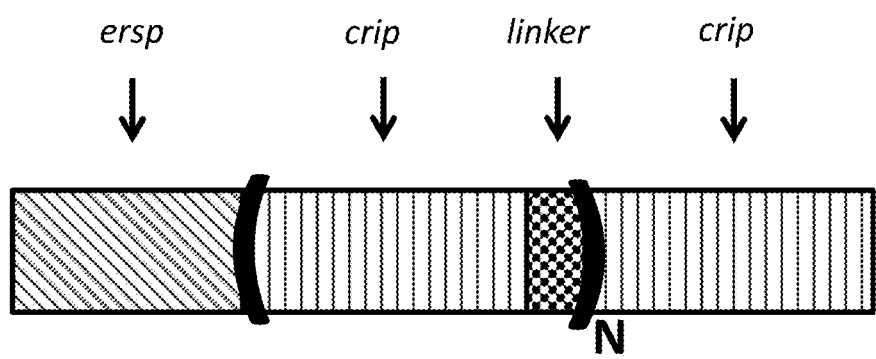
FIG. 5 is a diagram that shows that the CRIP-LINKER or ICK-LINKER group can also function as a STA-LINKER group. In other words, the combination of CRIP-LINKER or ICK-LINKER can function as a STA-LINKER. In other words one can use two ICK motifs with one LINKER and dispense with the need for a Translational Stabilizing Protein or STA.

In some embodiments the STA can even be CRIP or ICK as shown in FIG. 5. In these embodiments there is no separate STA protein, the STA protein is the same as the CRIP or ICK used. It could be the identical ICK that is bound with the LINKER, or there could be different ICKs one type bound to the LINKER and the other type acting as the STA. These alternative arrangements are also discussed in the section on LINKERS.

Additional examples of translational stabilizing proteins can be found in the following references, incorporated by reference in their entirety: Kramer, K. J. et al. "Sequence of a cDNA and expression of the gene encoding epidermal and gut chitinases of *Manduca sexta*" *Insect Biochemistry and Molecular Biology*, Vol. 23, Issue 6, September 1993, pp. 691-701. Kramer, K. J. et al. isolated and sequenced a chitinase-encoding cDNA from the tobacco hornworm, *Manduca sexta*. Hashimoto, Y. et al. "Location and nucleotide sequence of the gene encoding the viral enhancing factor of the *Trichoplusia ni* granulosis virus" *Journal of General Virology*, (1991), 72, 2645-2651. Hashimoto, Y. et al. cloned the gene encoding the viral enhancing factor of a *Trichoplusia ni* granulosis virus and determined the complete nucleotide sequence. Van Damme, E. J. M. et al. "Biosynthesis, primary structure and molecular cloning of snowdrop (*Galanthus nivalis* L.) lectin" *European Journal of Biochemistry*, 202, 23-30 (1991). Van Damme, E. J. M. et al. isolated Poly(A)-rich RNA from ripening ovaries of snowdrop lectin (GNA), yielding a single 17-kDa lectin polypeptide upon translation in a wheat-germ cell-free system, called agglutin. These references and others teach and disclose translational stabilizing proteins that can be used in the methods, procedures and peptide, protein and nucleotide complexes and constructs described herein.

Figure 3:
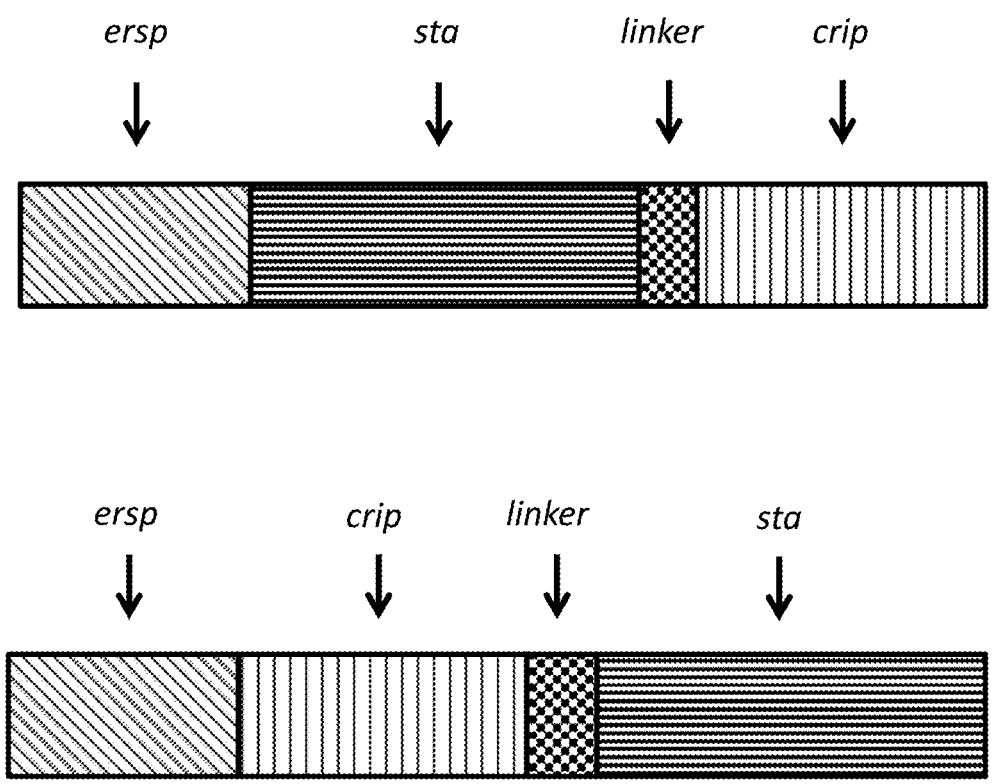
FIG. 3 is a diagram of invention of N-terminal fusion of ERSP (diagonal stripes) fused to a CRIP motif (vertical stripes) that is fused with a translational stabilizing protein (STA) shown in horizontal stripes. The STA is separated from the CRIP motif by an intervening sequence called an intervening linker peptide (LINKER) shown in checkerboard. Two possible orientations are shown in FIG. 3.
Figure 4:
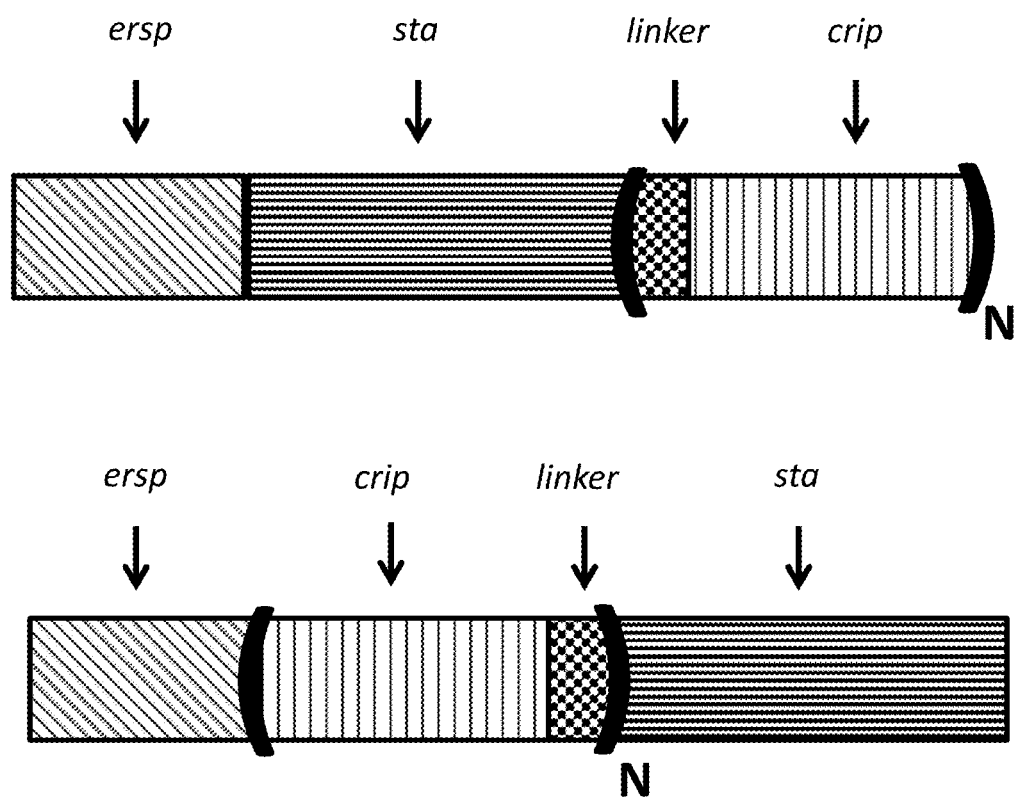
FIG. 4 is a diagram similar to FIG. 3 with the (LINKER-CRIP) motif with the subscript letter "N" to show that the LINKER-CRIP motif can be used once or repeated several time, preferably from 1-10 repeats and even more up to 15, 20 or 25 times are possible.

IV. The Intervening Linker Peptide Component, LINKER, Linker, L or if Polynucleotide: Linker or l of the PEPs The ICK motif protein expression ORF described in this invention also incorporates polynucleotide sequences encoding intervening linker peptides between the polynucleotide sequences encoding the ICK motif protein (ick) and the translational stabilizing protein (sta), or between polynucleotide sequences encoding multiple ICK motif proteins domain ((l-ick)$_N$ or (ick-l)$_N$) if the expression ORF involves multiple ICK motif protein domain expression. The intervening linker peptides (LINKERS) separate the different parts of the expressed ICK motif protein complex and help proper folding of the different parts of the complex during the expression process. In the expressed ICK motif protein complex, different intervening linker peptides can be involved to separate different functional domains. Various representations of proteins with LINKERS are shown in (FIGS. 3-5). The LINKER is attached to a CRIP such as an ICK and this bivalent group can be repeated up to 10 (N=1-10) and possibly even more than 10 times in order to facilitate the accumulation of properly folded insecticidal peptide in the plant that is to be protected.

The intervening linker peptide is usually between 1 and 30 amino acids in length. It is not necessary an essential component in the expressed ICK motif protein complex in plants. A cleavable linker peptide can be designed to the ICK motif protein expression ORF to release the properly folded ICK motif protein from the expressed ICK motif protein complex in the transformed plant to improve the protection the ICK motif protein to the plant from pest damage. One type of the intervening linker peptide is the plant cleavable linker peptide. This type of linker peptides can be completely removed from the expressed ICK motif protein expression complex during the post-translational expression process in the plant cells. Therefore the properly folded ICK motif protein linked by this type of intervening linker peptides can be released in the plant cells from the expressed ICK motif protein complex during the post-translational expression process. Here we show numerous examples of LINKERS.

Another type of the cleavable intervening linker peptide is not cleavable during the expression process in plants. However, it has a protease cleavage site specific to serine, threonine, cysteine, aspartate proteases or metalloproteases. The type of cleavable linker peptide can be digested by proteases found in the insect and lepidopteran gut environment and/or the insect hemolymph and lepidopteran hemolymph environment to release the ICK motif protein in the insect gut or hemolymph. Here we show numerous examples of LINKERS. These linkers are presented as examples only and should not be considered limiting the invention. Using the information taught by this disclosure it should be a matter of routine for one skilled in the art to make or find other examples of LINKERS that will be useful in this invention.

An example of a cleavable type of intervening linker that illustrates the invention is listed in SEQ ID NO: 1, but cleavable linkers are not limited to this example. SEQ ID NO: 1 (one letter code) is IGER and here we name it "IGER." The molecular weight of this intervening linker or LINKER is 473.53 Daltons.

An intervening linker peptide (LINKER) can also be one without any type of protease cleavage site, i.e. an uncleavable intervening linker peptide. An example of this is the linker ETMFKHGL (SEQ ID NO: 3).

Other examples of intervening linker peptides can be found in the following references, which are incorporated by reference herein in their entirety: A plant expressed serine proteinase inhibitor precursor was found to contain five homogeneous protein inhibitors separated by six same linker peptides in Heath et al. "*Characterization of the protease processing sites in a multidomain proteinase inhibitor precursor from Nicotiana alata*" European Journal of Biochemistry, 1995; 230: 250-257. A comparison of the folding behavior of green fluorescent proteins through six different linkers is explored in Chang, H. C. et al. "De novo folding of GFP fusion proteins: high efficiency in eukaryotes but not in bacteria" *Journal of Molecular Biology*, 2005 Oct. 21; 353(2): 397-409. An isoform of the human GalNAc-Ts family, GalNAc-T2, was shown to retain its localization and functionality upon expression in *N. benthamiana* plants by Daskalova, S. M. et al. "Engineering of N. benthamiana L. plants for production of N-acetylgalactosamine-glycosylated proteins" *BMC Biotechnology*, 2010 Aug. 24; 10: 62. The ability of endogenous plastid proteins to travel through stromules was shown in Kwok, E. Y. et al. "GFP-labelled Rubisco and aspartate aminotransferase are present in plastid stromules and traffic between plastids" *Journal of Experimental Botany*, 2004 March; 55(397): 595-604. Epub 2004 Jan. 30. A report on the engineering of the surface of the tobacco mosaic virus (TMV), virion, with a mosquito decapeptide hormone, trypsin-modulating oostatic factor (TMOF) was made by Borovsky, D. et al. "Expression of *Aedes* trypsin-modulating oostatic factor on the virion of TMV: A potential larvicide" *Proc Natl Acad Sci*, 2006 Dec. 12; 103(50): 18963-18968. These references and others teach and disclose the intervening linkers that can be used in the methods, procedures and peptide, protein and nucleotide complexes and constructs described herein.

The ICK motif protein expression ORF described above can be cloned into any plant expression vector for the ICK motif protein expression in plant transiently or stably.

Transient Plant Expression Systems

Transient plant expression systems can be used to promptly optimize the structure of the ICK motif protein expression ORF for some specific ICK motif protein expression in plants, including the necessity of some components, codon optimization of some components, optimization of the order of each components, etc. A transient plant expression vector is often derived from a plant virus genome. Plant virus vectors provide advantages in quick and high level of foreign gene expression in plant due to the infection nature of plant viruses. The full length of the plant viral genome can be used as a vector, but often a viral component is deleted, for example the coat protein, and transgenic ORFs are subcloned in that place. The ICK motif protein expression ORF can be subcloned into such a site to create a viral vector. These viral vectors can be introduced into plant mechanically since they are infectious themselves, for example through plant wound, spray-on etc. They can also be transformed into plants by agroinfection by cloning the virus vector into the T-DNA of the crown gall bacterium, *Agrobacterium tumefaciens*, or the hairy root bacterium, *Agrobacterium rhizogenes*. The expression of the ICK motif protein in this vector is controlled by the replication of the RNA virus, and the virus translation to mRNA for replication is controlled by a strong viral promoter, for example, 35S promoter from Cauliflower mosaic virus. Viral vectors with ICK motif protein expression ORF are usually cloned into T-DNA region in a binary vector that can replicate itself in both *E. coli* strains and *Agrobacterium* strains. The transient transformation of a plant can be done by infiltration of the plant leaves with the *Agrobacterium* cells which contain the viral vector for ICK motif protein expression. In the transient transformed plant, it is common for the foreign protein expression to be ceased in a short period of time due to the post-transcriptional gene silencing (PTGS). Sometimes a PTGS suppressing protein gene is necessary to be co-transformed into the plant transiently with the same type of viral vector that drives the expression of with the ICK motif protein expression ORF. This improves and extends the expression of the ICK motif protein in the plant. The most commonly used PTGS suppressing protein is P19 protein discovered from tomato bushy stunt virus (TBSV).

Figure 7:
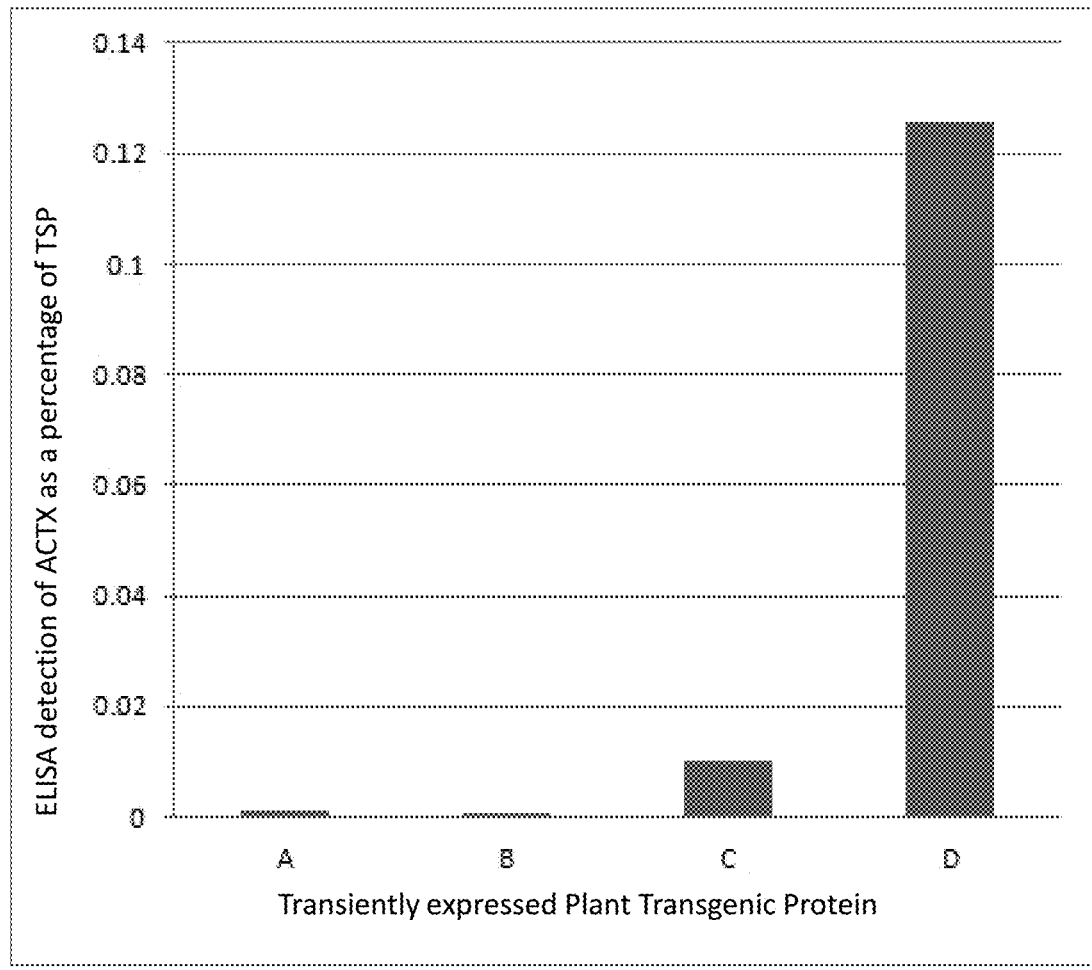
FIG. 7 is a graph of the ELISA detected levels of ACTX (as a percentage of Total Soluble Protein (% TSP) resulting from expression from plant transgenes encoding ACTX as a translational fusion with the various other structural elements.

A demonstration of transient plant expression can be found in FIG. 7.

FIG. 7 shows transiently expressed Plant Transgenic Protein. In FIG. 7 reports the relative accumulation of the ICK proteins compared to the % TSP, as detected by ELISA. There are four variations of ICK expression ORFs in FIG. 7 that illustrate the necessity of the ERSP to get proper folding of the ICK and the STA to get accumulation of the protein. Bar A reports a FECT expression system expressing SEQ ID NO: 8 the omega peptide (ICK) without any fusions. Bar B reports a TRBO expression system expressing SEQ ID NO: 9 a BAAS ERSP fused to the omega peptide (ICK). Bar C reports a FECT expression system expressing SEQ ID NO: 10 a GFP (STA) fused to IGER (Linker) fused to Hybrid toxin (ICK). Bar D reports a FECT expression system expressing SEQ ID NO: 11 a BAAS (ERSP) fused to a GFP (STA) fused to IGER (Linker) fused to Hybrid toxin (ICK). The detection levels for Bar A and B show negligible protein detection. In Bar A this is likely due to no proper folding of the ICK which occurs in the ER and in Bar B this is likely due to proper folding but no accumulation due to the lack of a STA. There are detectable levels in Bars C and D. When the experiment for Bar C [(SEQ ID NO: 10) a GFP (STA) fused to IGER (Linker) fused to Hybrid toxin (ICK)] was performed there was a high level of GFP fluorescence detected (data not shown) indicating much of the TSP was the fusion protein, however, when the ELISA was performed only 0.01% of the TSP was detected, and this is likely due to the lack of proper folding which did not occur as this protein was not targeted to the ER where folding occurs. The antibodies used in ELISA only detect the tertiary structure of a properly folded protein. When the experiment for Bar D [SEQ ID NO: 11 a BAAS (ERSP) fused to a GFP (STA) fused to IGER (Linker) fused to Hybrid toxin (ICK)] was performed there was some GFP fluorescence detected and an accumulation 0.10% of the TSP the ICK peptide fused to GFP. When the data for Bars A, B, C and D is taken together it is apparent that an ERSP in the ICK expression ORF is required to get proper folding and to increase the accumulation of the peptide a STA is required.

We have demonstrated and documented GFP emission of the green fluorescence of GFP-Hybrid fusion protein constructs in tobacco leaves transiently transformed using different FECT vectors designed for targeted expression. We have succeeded in using pFECT-BGIH vector for APO (apoplast localization) accumulation; pFECT-GIH vector for CYTO (cytoplasm localization) accumulation; and pFECT-BGIH-ER vector for ER (endoplasm reticulum localization) accumulation. Data not shown.

We have demonstrated and documented GFP emission of the green fluorescence of GFP-Hybrid fusion protein constructs in tobacco leaves transiently transformed using different types of ERSP. We have succeeded in demonstrating expression with pFECT-BGIH vector; expression with pFECT-EGIH vector; and expression with pFECT-E*GIH vector. Data not shown.

Figure 8:
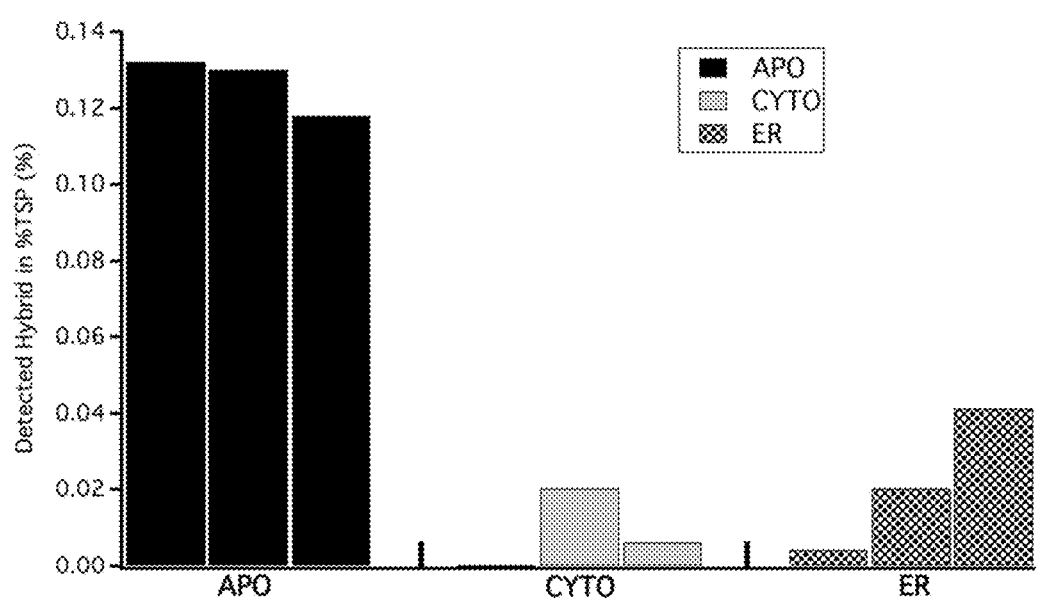
FIG. 8 is a graph of iELISA detected % TSPs of tobacco transiently expressed GFP fused U-ACTX-Hv1a with different accumulation localization. APO: apoplast localization; CYTO: cytoplasm localization: ER: endoplasm reticulum localization.
Figure 9:
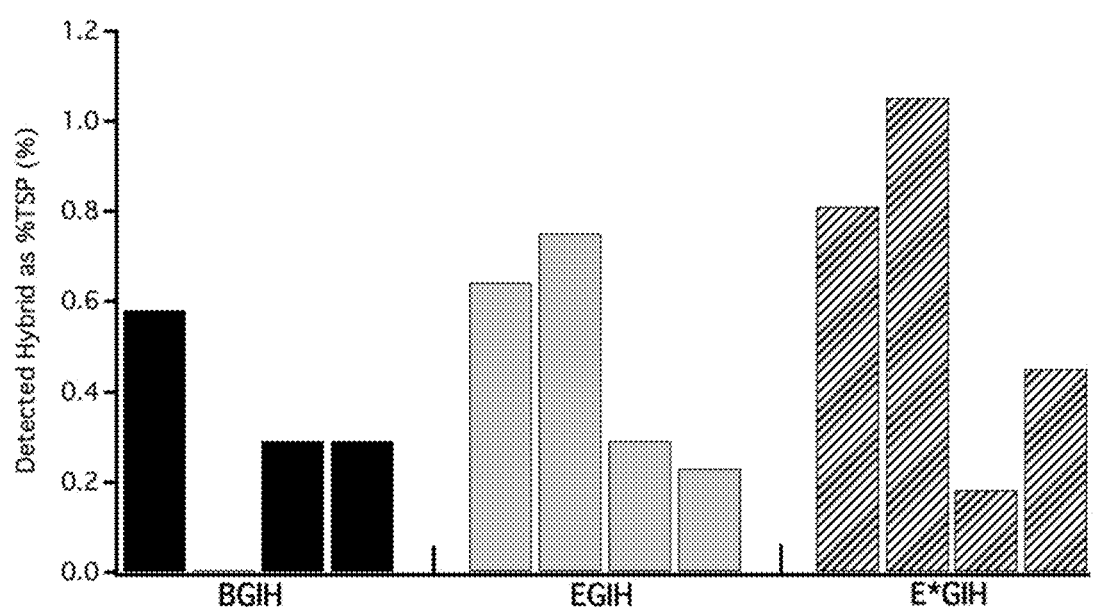
FIG. 9 is a graph of iELISA detected % TSPs of tobacco leaves transiently expressing GFP fused U-ACTX-Hv1a using the FECT expression vectors encoding translational fusions with three different ERSP sequences: BAAS signal peptide (BGIH). Extensin signal peptide (EGIH) and modified Extensin signal peptide (E*GIH).

We have measured levels of peptide accumulation and this is shown in FIGS. 8 and 9. FIG. 8 is a graph of iELISA detected % TSPs of tobacco transiently expressed GFP fused U-ACTX-Hv1a with different accumulation localization. APO: apoplast localization; CYTO: cytoplasm localization; ER: endoplasm reticulum localization. FIG. 9 is a graph of iELISA detected % TSPs of tobacco leaves transiently expressing GFP fused U-ACTX-Hv1a using the FECT expression vectors encoding translational fusions with three different ERSP sequences: BAAS signal peptide (BGIH), Extensin signal peptide (EGIH) and modified Extensin signal peptide (E*GIH).

Integration of Protein Expression ORF into Plant Genome Using Stable Plant Transformation Technology The ICK motif protein expression ORF can also be integrated into plant genome using stable plant transformation technology, and therefore ICK motif proteins can be stably expressed in plants and protect the transformed plants from generation to generation. For the stable transformation of plants, the ICK motif protein expression vector can be circular or linear. A few critical components must be included in the vector DNA. The ICK motif protein expression ORF for stable plant transformation should be carefully designed for optimal expression in plants based on the study in the transient plant expression as described above.

The expression of ICK motif protein is usually controlled by a promoter that promoters transcription in some of all cells of the transgenic plant. The promoter can be a strong plant viral promoter, for example, the constitutive 35S promoter from Cauliflower Mosaic Virus (CaMV); it also can be a strong plant promoter, for example, the hydroperoxide lyase promoter (pHPL) from *Arabidopsis thaliana*; the Glycine max polyubiquitin (Gmubi) promoter from soybean; the ubiquitin promoters from different plant species (rice, corn, potato, etc.), etc. A plant transcriptional terminator often occurs after the stop codon of the ORF to halt the RNA polymerase and transcription of the mRNA. To evaluate the ICK motif protein expression, a reporter gene can be included in the ICK motif protein expression vector, for example, beta-glucuronidase gene (GUS) for GUS straining assay, green fluorescent protein (GFP) gene for green fluorescence detection under UV light, etc. For selection of transformed plants, a selection marker gene is usually included in the ICK motif protein expression vector. The marker gene expression product can provide the transformed plant with resistance to specific antibiotics, for example, kanamycin, hygromycin, etc., or specific herbicide, for example, glyphosate etc. If agroinfection technology is adopted for plant transformation, T-DNA left border and right border sequences are also included in the ICK motif protein expression vector to transport the T-DNA portion into the plant. The constructed ICK motif protein expression vector can be transform into plant cells or tissues using many transformation technologies. Agroinfection is a very popular way to transform a plant using an *Agrobacterium tumefaciens* strain or an *Agrobacterium rhizogenes* strain. Particle bombardment (also called Gene Gun, or Biolistics) technology is also very commonly used for plant transformation. Other less commonly used transformation methods include tissue electroportation, silicon carbide whiskers, direct injection of DNA, etc. After transformation, the transformed plant cells or tissues placed on plant regeneration media to regenerate successfully transformed plant cells or tissues into transgenic plants. The evaluation of the integration and expression of the ICK motif protein expression ORF in the transformed plant can be performed as follows.

Evaluation of a Transformed Plant

Evaluation of a transformed plant can be done in DNA level, RNA level and protein level. A stably transformed plant can be evaluated at all of these levels and a transiently transformed plant is usually only evaluated at protein level. To ensure that the ICK expression motif protein expression ORF integrates into the genome of a stably transformed plant, the genomic DNA can be extracted from the stably transformed plant tissues for the PCR evaluation or the Southern blot application. The expression of the ICK motif protein in the stably transformed plant can be evaluated in RNA level, i.e. the total mRNA can be extracted from the transformed plant tissues and the northern blot technique and the RT-PCR technology can applied to evaluate the mRNA level of the ICK motif protein qualitatively or quantitatively. The expression of the ICK motif protein in the transformed plant can also be evaluated in protein level directly. There are many ways to evaluate the ICK motif protein expressed in a transformed plant. If a reporter gene is transformed into the plant along with the ICK motif protein expression ORF, the reporter gene assay can be performed to initially evaluate the expression of the transformed ICK motif protein expression ORF, for example, GUS straining assay for GUS reporter gene expression, green fluorescence detection assay for GFP reporter gene expression, luciferase assay for luciferase reporter gene expression, etc. Moreover, the total expressed protein can be extracted from the transformed plant tissues for the direct evaluation of the expression of the ICK motif protein in the transformed plants. The extracted total expressed protein sample can be used in Bradford assay to evaluate the total protein level in the sample. Analytical HPLC chromatography technology, Western blot technique, or iELISA assay can be adopted to qualitatively or quantitatively evaluate the ICK motif protein in the extracted total protein sample from the transformed plant tissues. The ICK motif protein expression can also be evaluated by using the extracted total protein sample from the transformed plant tissues in an insect bioassay. Finally, the transformed plant tissue or the whole transformed plant can be tested in insect bioassays to evaluate the ICK motif protein expression and its protection for the plant.

We provide a detailed description and summary of Part I as follows:

We describe a protein comprised of an Endoplasmic Reticulum Signal Peptide (ERSP) operably linked to a Cysteine Rich Insecticidal Protein (CRIP) such as an Inhibitor Cysteine Knot (ICK) motif protein wherein said ERSP is the N-terminal of said protein (ERSP-ICK). The ERSP is any signal peptide which directs the expressed CRIP to the endoplasmic reticulum of plant cells. The CRIP can be an Inhibitor Cysteine Knot (ICK) protein or a Non-ICK protein. The ERSP is a peptide between 5 to 50 amino acids in length, originating from a plant, that is operably linked to a Translational Stabilizing Protein (STA), wherein said ERSP is the N-terminal of said protein and an intervening STA sequence may be either on the N-terminal side of the CRIP, which is optionally an ICK motif protein (ERSP-STA-ICK); or Non-ICK motif protein (ERSP-STA-Non-ICK) or on the C-terminal side of the ICK or Non-ICK motif protein (ERSP-ICK-STA) or (ERSP—Non-ICK- STA). The ERSP is a peptide between 3 to 60 amino acids in length, or a peptide between 5 to 50 amino acids in length, or a peptide between 20 to 30 amino acids in length. It can originate from a plant, Barley Alpha-Amylase Signal peptide (BAAS) with a SEQ ID NO 4. The ERSP can be a peptide that is tobacco extensin signal peptide with a SEQ ID NO 18. The ERSP can be a modified tobacco extensin signal peptide with a SEQ ID NO 19 or a Jun a 3 signal peptide from *Juniperus ashei* with a SEQ ID NO 27.

We describe a CRIP example that is an ICK motif protein is between 16 and 60 amino acids in length, between 26 and 48 amino acids in length, between 30 and 44 amino acids in length, where it is selected from any of the peptides or sources of peptides with inhibitory cysteine knot motif, or a insecticidal peptide and where it is any of the peptides or sources of peptides including *Atrax* or *Hadronyche*, any of the peptides originating from *Hadronyche versuta*, an ACTX peptide. The ICK motif protein is any insecticidal peptide and fragments thereof including mature, pre, and pro peptide versions of said peptides and sequence numbers as well as any mutations, or deletion, or addition of peptide segments but still maintenance of inhibitory cysteine knot structure. The ICK motif protein can be U-ACTX-Hv1a with SEQ ID NO: 6, Omega-ACTX-Hv1a with SEQ ID NO: 24, Kappa-ACTX-Hv1c. An expression ORF comprising any of the nucleotides that code for those peptides. An expression ORF comprising any of the nucleotides that code for the peptides integrated into a transgenic plant genome. The use of any of the peptides or nucleotides described herein to make or transform a plant or plant genome in order to express properly folded insecticidal peptides in a transformed plant and or to make or transform a plant or plant genome in order to express properly folded insecticidal peptides in the transformed plant and to cause the accumulation of the expressed and properly folded insecticidal peptides in said plant and to cause an increase the plant's resistance to insect damage. We describe procedures to use nucleotides to create transgenic plants and transformed plants having or expressing any of the peptides described herein. We describe a transformed plant made by any of these products and processes.

We describe a protein comprised of an Endoplasmic Reticulum Signal Peptide (ERSP) operably linked to a CRIP which is optionally an Inhibitor Cysteine Knot (ICK) motif protein or Non-ICK protein operably linked to a Translational Stabilizing Protein (STA), wherein said ERSP is the N-terminal of said protein and an intervening Translational Stabilizing Protein sequence may be either on the N-terminal side of the ICK motif protein (ERSP-STA-ICK or optionally a (ERSP-Non-ICK-STA) or the C-terminal side of the ICK motif protein (ERSP-ICK-STA) or ERSP-STA-Non-ICK).

We describe such a STA with a molecular weight of 12 kD and above, where said STA can be many proteins, including an ICK motif protein with molecular weight of 12 kD and above, or multiple ICK motif proteins connected with linker peptides (L) with molecular weight of 12 kD and above, for example ERSP-ICK-$(L_i$-ICK$_j)_N$, or ERSP-$(ICK_j$-$L_i)_N$-ICK.

We explain the linker peptides can be the same or different. We say that one STA is a green fluorescence protein (GFP) originating from jellyfish with SEQ ID NO 13 and the STA can be a snowdrop lectin, *Galanthus nivalis* agglutinin (GNA), with SEQ ID NO 28 and that STA can be a *Juniperus ashei* protein, Jun a 3, with SEQ ID NO 26.

We describe a LINKER is any peptide with 4-20 amino acids in length. We describe a LINKER that is any peptide containing a protease recognition site. We describe a LINKER as any peptide containing a plant protease cleavage site. We describe a LINKER is a peptide containing an amino acid sequence of IGER (SEQ ID NO: 1), EEKKN (SEQ ID NO: 2) and (SEQ ID NO: 3). We describe a LINKER as any peptide which can be cleaved in the insect digestive system, or in the insect hemolymph. We describe a LINKERs wherein said LINKER is a peptide containing a trypsin cleavage site.

We describe a nucleotide that codes for any of the proteins described including expression ORFs comprising any of the nucleotides that code for the peptides, as well as expression ORF comprising any of the nucleotides that code for the peptides, integrated into a transgenic plant genome, as well as transformed into a plant or plant genome in order to express properly folded insecticidal peptides in a transformed plant, as well as transformed into a plant or plant genome in order to express properly folded insecticidal peptides in the transformed plant and to cause the accumulation of the expressed and properly folded insecticidal peptides in said plant and to cause an increase the plant's resistance to insect damage. We describe transgenic plants that result from these descriptions and transformed plants having or expressing any of the peptides described herein.

We explain and describe an expression ORF comprising any of the nucleotides that code for the peptides herein as well an expression ORF integrated into a transgenic plant genome, and one reason this is done is to make or transform a plant or plant genome in order to express properly folded insecticidal peptides in a transformed plant and one reason this is done is to have the transformed plant cause the accumulation of the expressed and properly folded insecticidal peptides in said plant and to cause an increase the plant's resistance to insect damage. We teach how to make the transgenic plants using these procedures and expressing the peptides herein and any other peptides that one skilled in the art would use given the teaching herein and using any of the products and processes described herein.

We teach how to make a protein comprised of an Endoplasmic Reticulum Signal Peptide (ERSP) operably linked to an Inhibitor Cysteine Knot (ICK) motif protein operably linked to translational stabilizing protein (STA), operably linked to an intervening linker peptide (L), wherein said ERSP is the N-terminal of said protein, and said LINKER is between STA and the ICK motif protein, and said translational stabilizing protein may be either on the N-terminal side (upstream) of the ICK motif protein or the C-terminal side (downstream) of the ICK motif protein, and described as ERSP-STA-L-ICK, or ERSP-ICK-L-STA. And we explain the aforementioned ERSP, CRIP and ICK, LINKER, STA can be any of the peptides as described herein and any other peptides that one skilled in the art would use given the teaching herein and using any of the products and processes described herein.

We teach how to make a protein comprised of an Endoplasmic Reticulum Signal Peptide (ERSP) operably linked to a multiple Inhibitor Cysteine Knot (ICK) motif protein domain in which ICK motif proteins are linked to each other via intervening linker peptides (L), operably linked to a translational stabilizing protein (STA), operably linked to an intervening linker peptide (L), wherein said ERSP is the N-terminal of said protein, and said LINKER is between STA and the multiple ICK motif proteins domain, and said STA may be either on the N-terminal side (upstream) of the multiple ICK motif protein domain or the C-terminal side (downstream) of the multiple ICK motif protein domain, and described as ERSP-STA-($L_i$-$ICK_j$)$_N$, or ERSP-($ICK_j$-$L_i$)$_N$-STA.

We teach how to make the nucleotides that code for these proteins, the expression ORFs, to make a and to integrated into a transgenic plant genome, the chimeric genes, recombinant vectors, transgenic host cells, transgenic plant cells, transgenic plants, transgenic plants of which are corn, soybean, cotton, rice, wheat, sorghum, switchgrass, sugarcane, alfalfa, potatoes, tomatoes, tobacco, any of green leafy vegetables, or any of fruit trees, or any plants and species as mentioned herein, and a seed from a transgenic plant according to these procedures where the seed comprises the chimeric gene.

EXAMPLES

The Examples in this specification are not intended to, and should not be used to, limit the invention; they are provided only to illustrate the invention.

Example 1

Expression Comparison Between Two Transient Plant Expression Systems.

The transient plant transformation technologies were adopted to promptly optimize the ICK motif protein expression ORF for plant expression. Agroinfection technology with a plant viral vector has been used here for the transient plant transformation due to its high efficiency, easiness and inexpensiveness. Two viral transient plant expression systems were evaluated here for the ICK motif protein expression in plants. One was a tobacco mosaic virus overexpression system (TRBO, Lindbo J A, Plant Physiology, 2007, V145: 1232-1240). The TRBO DNA vector has a T-DNA region for agroinfection, which contains a CaMV 35S promoter that drives expression of the tobacco mosaic virus RNA without the gene encoding the viral coating protein. The other viral transient plant expression system was the FECT expression system (Liu Z & Kearney C M, BMC Biotechnology, 2010, 10:88). The FECT vector also contains a T-DNA region for agroinfection, which contains a CaMV 35S promoter that drives the expression of the foxtail mosaic virus RNA without the genes encoding the viral coating protein and the triple gene block. Both expression systems use the "disarmed" virus genome, therefore viral plant to plant transmission can be effectively prevented. To efficiently express the introduced heterologous gene, the FECT expression system additionally needs to co-express P19, a RNA silencing suppressor protein from tomato bushy stunt virus, to prevent the post-transcriptional gene silencing (PTGS) of the introduced T-DNA. (The TRBO expression system does not need co-expression of P19). The two transient plant expression systems were tested and compared by transient expression of ICK motif protein in Tobacco (Nicotiana benthamiana) as described below.

The ICK motif protein expression ORF was designed to encode a series of translationally fused structural motifs that can be described as follows: N'-ERSP-Sta-L-ICK-C'. Here the ICK motif protein for expression is U-ACTX-Hv1a, which has the following amino acid sequence (N' to C', one letter code):

```
                                       (SEQ ID NO: 12)
QYCVPVDQPCSLNTQPCCDDATCTQERNENGHTVYYCRA
```

The ERSP motif used here is the Barley Alpha-Amylase Signal peptide (BAAS), which comprises of 24 Amino acids as shown below (N' to C', one letter code):

```
                                        (SEQ ID NO: 4)
             MANKHLSLSLFLVLLGLSASLASG
```

The stabilizing protein (Sta) in this expression ORF was Green Fluorescent Protein (GFP), which has amino acid sequence as follows (N' to C', one letter code):

```
                                       (SEQ ID NO: 13)
MASKGEELFTGVVPILVELDGDVNGHKFSVSGEGEGDATYGKLTLKFICT

TGKLPVPWPTLVTTFSYGVQCFSRYPDHMKRHDFFKSAMPEGYVQERTIS

FKDDGNYKTRAEVKFEGDTLVNRIELKGIDFKEDGNILGHKLEYNYNSHN

VYITADKQKNGIKANFKIRHNIEDGSVQLADHYQQNTPIGDGPVLLPDNH

YLSTQSALSKDPNEKRDHMVLLEFVTAAGITHGMDELYK
```

The linker peptide between GFP and U-ACTX-Hv1a contains the trypsin cleavage site and has an amino acid sequence as shown below (N' to C', one letter code):

```
                                        (SEQ ID NO: 1)
                    IGER
```

According to the ICK motif expression ORF formula, this specific ICK expression ORF can be described as BAAS-GFP-IGER-Hybrid, or BGIH. The BGIH ORF was chemically synthesized by adding Pac I restriction site at its 5' terminus and Avr II restriction site at its 3' terminus. The sequence of the synthetic BGIH is below:

```
                                       (SEQ ID NO: 14)
TTAATTAAATGGCTAATAAACACCTGAGTTTGTCACTATTCCTCGTGTTG

CTCGGGTTATCTGCTTCACTTGCAAGCGGAGCTAGCAAAGGAGAAGAACT

TTTCACTGGAGTTGTCCCAATTCTTGTTGAATTAGATGGTGATGTTAATG

GGCACAAATTTTCTGTCAGTGGAGAGGGTGAAGGTGATGCTACATACGGA
```

```
-continued
AAGCTTACCCTTAAATTTATTTGCACTACTGGAAAACTACCTGTTCCATG

GCCAACACTTGTCACTACTTTCTCTTATGGTGTTCAATGCTTTTCCCGTT

ATCCGGATCATATGAAACGGCATGACTTTTTCAAGAGTGCCATGCCCGAA

GGTTATGTACAGGAACGCACTATATCTTTCAAAGATGACGGGAACTACAA

GACGCGTGCTGAAGTCAAGTTTGAAGGTGATACCCTTGTTAATCGTATCG

AGTTAAAAGGTATTGATTTTAAAGAAGATGGAAACATTCTCGGACACAAA

CTCGAGTACAACTATAACTCACACAATGTATACATCACGGCAGACAAACA

AAAGAATGGAATCAAAGCTAACTTCAAAATTCGCCACAACATTGAAGATG

GATCCGTTCAACTAGCAGACCATTATCAACAAAATACTCCAATTGGCGAT

GGCCCTGTCCTTTTACCAGACAACCATTACCTGTCGACACAATCTGCCCT

TTCGAAAGATCCCAACGAAAAGCGTGACCACATGGTCCTTCTTGAGTTTG

TAACTGCTGCTGGGATTACACATGGCATGGATGAGCTCTACAAAATTGGT

GAAAGACAATATTGTGTTCCAGTTGATCAACCATGTTCTCTTAATACTCA

ACCATGTTGTGATGATGCTACTTGTACTCAAGAAAGAAATGAAAATGGAC

ATACTGTTTATTATTGTAGAGCTTAACCTAGG
```

The BGIH ORF was cloned into the Pac I and Avr II restriction sites of the FECT expression vector to create a BGIH expression vector for the FECT transient plant expression system (pFECT-BGIH). To maximize BGIH expression in the FECT expression system, a FECT vector expressing the RNA silencing suppressor protein P19 (pFECT-P19) was generated for co-transformation. To create a BGIH expression vector for TRBO transient plant expression system, a routine PCR procedure was performed to add a Not I restriction site to the 3' terminus of the BGIH ORF described above. The new BGIH ORF was then cloned into Pac I and Not I restriction sites of the TRBO expression vector to create a BGIH expression vector for the TRBO transient plant expression system (pTRBO-BGIH).

An *Agrobacterium tumefaciens* strain, GV3101, was used for the transient expression of BGIH in tobacco leaves by the FECT and TRBO expression systems. To make competent GV3101 cells the following procedure was performed: an overnight culture of GV3101 was used to inoculate 200 mL Luria-Bertani (LB) medium. The cells were then allowed to grow to log phase with OD600 between 0.5 and 0.8. Then the cells were pelleted by centrifugation at 5000 rpm for 10 minutes at 4° C. The cells were then washed once with 10 mL prechilled TE buffer (Tris-HCl 10 mM, EDTA 1 mM, pH8.0), and then resuspended into 20 mL LB medium. The GV3101 cell resuspension was then aliquoted in 250 μL fractions into 1.5 mL microtubes. The aliquots were then snap-frozen in liquid nitrogen and stored at −80° C. freezer for future transformation.

The pFECT-BGIH and pTRBO-BGIH vectors were then transformed into the competent GV3101 cells using a freeze-thaw method as follows: the stored competent GV3101 cells were thawed on ice and then mixed with 1-5 μg pure DNA (pFECT-BGIH or pTRBO-BGIH vector). The cell-DNA mixture was then kept on ice for 5 minutes, then transferred to −80° C. for 5 minutes, and then incubated in a 37° C. water bath for 5 minutes. The freeze-thaw treated cells were then diluted into 1 mL LB medium and shaken on a rocking table for 2-4 hours at room temperature. A 200 μL aliquot of the cell-DNA mixture was then spread onto LB agar plates with the appropriate antibiotics (10 μg/mL rifampicin, 25 μg/mL gentamycin, and 50 μg/mL kanamycin were used for both pFECT-BGIH transformation and pTRBO-BGIH transformation) and incubated at 28° C. for two days. Resulting transformant colonies were then picked and culture in 6 mL aliquots of LB medium with the appropriate antibiotics for transformed DNA analysis and making glycerol stocks of the transformed GV3101 cells.

The transient transformation of tobacco leaves was performed using leaf injection with a 3 mL syringe without needle. The transformed GV3101 cells were streaked onto an LB plate with the appropriate antibiotics (as described above) and incubated at 28° C. for two days. A colony of transformed GV3101 cells was inoculated to 5 ml of LB-MESA medium (LB media supplemented with 10 mM MES, 20 μM acetosyringone) and the same antibiotics described above, and grown overnight at 28° C. The cells of the overnight culture were collected by centrifugation at 5000 rpm for 10 minutes and resuspended in the induction medium (10 mM MES, 10 mM MgCl2, 100 μM acetosyringone) at a final OD600 of 1.0. The cells were then incubated in the induction medium for 2 hour to overnight at room temperature and were then ready for transient transformation of tobacco leaves. The treated cells were infiltrated into the underside of attached leaves of *Nicotiana benthamiana* plants by injection, using a 3 mL syringe without a needle attached. For the FECT transient transformation, the pFECT-BGIH transformed GV3101 cells and pFECT-P19 transformed GV3101 cells were mixed together in equal amounts for infiltration of tobacco leaves by injection with a 3 mL syringe. For the TRBO transient transformation, only pTRBO-BGIH transformed GV3101 cells were infiltrated into tobacco leaves. The ICK motif protein expression in tobacco leaves was evaluated at 6-8 days post-infiltration.

The BGIH expression ORF contains a fusion protein of GFP (STA) and U-ACTX-Hv1a (ICK) with an IGER (SEQ ID NO: 1) linker peptide (LINKER) between them. As shown in FIG. 3, the green fluorescence of the expressed GFP portion of the transgenes was detected under U.V. light in tobacco leaves transformed with both the FECT and TRBO vectors. Interestingly, green fluorescence appeared evenly distributed in the FECT vector transformed tobacco leaves (with the exception of the vascular tissues), whereas green fluorescence in the TRBO vector transformed tobacco leaves appeared to accumulate in the vascular tissues which is due to TRBO retaining its viral movement protein and FECT not.

To quantitatively evaluate the ICK motif protein expression, the expressed proteins in the transformed tobacco leaves were extracted by following the procedure described here. 100 mg disks of transformed leaf tissue were collected by punching leaves with the large opening of a 1000 μL pipette tip. The collected leaf tissue was place into a 2 mL microtube with 5/32" diameter stainless steel grinding balls, and frozen in −80° C. for 1 hour, and then homogenized using a Troemner-Talboys High Throughput Homogenizer. 750 μL ice-cold TSP-SE1 extraction solutions (sodium phosphate solution 50 mM, 1:100 diluted protease inhibitor cocktail, EDTA 1 mM, DIECA 10 mM, PVPP 8%, pH 7.0) was added into the tube and vortexed. The microtube was then left still at room temperature for 15 minutes and then centrifuged at 16,000 g for 15 minutes at 4° C. 100 μL of the resulting supernatant was taken and loaded into pre-Sephadex G-50-packed column in 0.45 μm Millipore Multi-Screen filter microtiter plate with empty receiving Costar microtiter plate on bottom. The microtiter plates were then centrifuged at 800 g for 2 minutes at 4° C. The resulting filtrate solution, herein called total soluble protein extract (TSP extract) of the tobacco leaves, was ready for the quantitative analysis.

The total soluble protein concentration of the TSP extract was estimated using Pierce Coomassie Plus protein assay. BSA protein standards with known concentrations were used to generate a protein quantification standard curve. 2 µL of each TSP extract was mixed into 200 µL of the chromogenic reagent (CPPA reagent) of the Coomassie Plus protein assay kits and let react for 10 minutes. The chromogenic reaction was then evaluated by reading OD595 using a SpectroMax-M2 plate reader using SoftMax Pro as control software. The concentrations of total soluble proteins were 0.788±0.20 µg/µL and 0.533±0.03 µg/µL in the TSP extract from FECT-BGIH expression leaves and TRBO-BGIH expression leaves respectively. These results were used for the calculation of percentage of the expressed U-ACTX-Hv1a in the TSP (% TSP) in the iELISA assay.

Indirect ELISA (iELISA) assay was performed as follows to quantitatively evaluate the ICK motif protein in the tobacco leaves transiently transformed with the FECT and TRBO expression systems. 5 µL of the leaf TSP extract was diluted into 95 µL CB2 solution (Immunochemistry Technologies) in the well of an Immulon 2HD 96-well plate, with serial dilutions performed as necessary. Leaf proteins were from the extract samples were then allowed to coat the well walls for 3 hours in the dark at room temperature, and then the CB2 solution was removed, and each well was washed twice with 200 µL PBS (Gibco). 150 µL blocking solution (Block BSA in PBS with 5% non-fat dry milk) was then added into each well and incubated for 1 hour, in the dark, at room temperature. After the removal of the blocking solution and a PBS wash of the wells, 100 µL of rabbit anti-U-ACTX-Hv1a antibody (primary antibody) (1:250 dilution in blocking solution) was added to each well and incubated for 1 hour in the dark at room temperature. The primary antibody was then removed and each well was washed with PBS 4 times. Then 100 µL of HRP-conjugated goat anti-rabbit antibody (secondary antibody, used at 1:1000 dilution in the blocking solution) was added into each well and incubated for 1 hour in the dark at room temperature. After removal of the secondary antibody and wash of the wells with PBS, 100 µL substrate solution (a 1:1 mixture of ABTS peroxidase substrate solution A and solution B, KPL) was added to each well, and the chromogenic reaction was allowed to go until sufficient color development was apparent. Then 100 µL of peroxidase stop solution was added to each well to stop the reaction. The light absorbance of each reaction mixture in the plate was read at 405 nm using a SpectroMax-M2 plate reader, with SoftMax Pro used as control software. Serially diluted known concentrations of pure U-ACTX-Hv1a samples were treated in the same manner as described above in the iELISA assay to generate a mass-absorbance standard curve for quantities analysis. The expressed U-ACTX-Hv1a was detected by iELISA at 3.09±1.83 ng/µL in the leaf TSP extracts from the FECT-BGIH transformed tobacco; and 3.56±0.74 ng/µL in the leaf TSP extract from the TRBO-BGIH transformed tobacco. Or the expressed U-ACTX-Hv1a is 0.40% total soluble protein (% TSP) for FECT-BGIH transformants and 0.67% TSP in TRBO-BGIH transformants.

In conclusion, both FECT and TRBO transient plant expression systems can be used to express the ICK motif protein in plant. The ICK motif protein expression level in both systems is very close. However, the expression in the FECT system distributes evenly in the agroinfiltrated leaves, whereas the expression in the TRBO system accumulates in the vascular tissue of the agroinfiltrated leaves.

Example 2

ICK Motif Protein Transient Expression in Tobacco Leaf with Accumulation at Different Subcellular Targets.

Plant expressed ICK motif protein needs to accumulate to a certain level in the plant to effectively protect the plant from insect damage. The accumulation level of the plant expressed ICK motif protein may be affected by its final localization in the plant cells. In this example, we investigated the effects of different subcellular localizations of the plant expressed ICK motif protein on the protein's accumulation level in the plant (using the FECT transient plant expression system). Three subcellular targets were investigated in this example, plant cell wall apoplast (APO), the endoplasmic reticulum (ER) and the cytoplasm (CYTO).

The APO targeted ICK motif protein expression ORF was designed to encode a series of translationally fused structural motifs that can be described as follows: N'-ERSP-Sta-L-ICK-C'. Again the ICK motif protein in this study was U-ACTX-Hv1a, and the BGIH expression ORF in the example 1 was used. The same vector as in the example 1, pFECT-BGIH, was used here.

The CYTO targeted ICK motif protein expression ORF was designed to encode a series of translationally fused structural motifs that can be described as follows: N'-Sta-L-ICK-C'. In this study, the DNA sequence encoding barley α-amylase signal peptide was removed from the BGIH expression ORF and became the GIH expression ORF, whose open reading frame sequence is below:

```
(SEQ ID NO: 15)
ATGGCTAGCAAAGGAGAAGAACTTTTCACTGGAGTTGTCCCAATTCTTGT

TGAATTAGATGGTGATGTTAATGGGCACAAATTTTCTGTCAGTGGAGAGG

GTGAAGGTGATGCTACATACGGAAAGCTTACCCTTAAATTTATTTGCACT

ACTGGAAAACTACCTGTTCCATGGCCAACACTTGTCACTACTTTCTCTTA

TGGTGTTCAATGCTTTTCCCGTTATCCGGATCATATGAAACGGCATGACT

TTTTCAAGAGTGCCATGCCCGAAGGTTATGTACAGGAACGCACTATATCT

TTCAAAGATGACGGGAACTACAAGACGCGTGCTGAAGTCAAGTTTGAAGG

TGATACCCTTGTTAATCGTATCGAGTTAAAAGGTATTGATTTTAAAGAAG

ATGGAAACATTCTCGGACACAAACTCGAGTACAACTATAACTCACACAAT

GTATACATCACGGCAGACAAACAAAAGAATGGAATCAAAGCTAACTTCAA

AATTCGCCACAACATTGAAGATGGATCCGTTCAACTAGCAGACCATTATC

AACAAAATACTCCAATTGGCGATGGCCCTGTCCTTTTACCAGACAACCAT

TACCTGTCGACACAATCTGCCCTTTCGAAAGATCCCAACGAAAAGCGTGA

CCACATGGTCCTTCTTGAGTTTGTAACTGCTGCTGGGATTACACATGGCA

TGGATGAGCTCTACAAAATTGGTGAAAGACAATATTGTGTTCCAGTTGAT

CAACCATGTTCTCTTAATACTCAACCATGTTGTGATGATGCTACTTGTAC

TCAAGAAAGAAATGAAAATGGACATACTGTTTATTATTGTAGAGCTTAA
```

The GIH expression ORF was cloned into the Pac I and Avr II restriction sites of the FECT expression vector to create a GIH expression vector for FECT transient plant expression system (pFECT-GIH) for the CYTO targeting expression of U-ACTX-Hv1a.

The ER targeted ICK motif protein expression ORF was designed by adding a DNA sequence encoding the ER targeting signal peptide at the C' end of the BGIH expression ORF which was named as BGIH-ER expression ORF. The ER targeting signal peptide used here has the following amino acid sequence (one letter code for amino acid):

(SEQ ID NO: 16)
KDEL

The DNA sequence of the BGIH-ER expression ORF is as follows:

(SEQ ID NO: 17)
ATGGCTAATAAACACCTGAGTTTGTCACTATTCCTCGTGTTGCTCGGGTT

ATCTGCTTCACTTGCAAGCGGAGCTAGCAAAGGAGAAGAACTTTTCACTG

GAGTTGTCCCAATTCTTGTTGAATTAGATGGTGATGTTAATGGGCACAAA

TTTTCTGTCAGTGGAGAGGGTGAAGGTGATGCTACATACGGAAAGCTTAC

CCTTAAATTTATTTGCACTACTGGAAAACTACCTGTTCCATGGCCAACAC

TTGTCACTACTTTCTCTTATGGTGTTCAATGCTTTTCCCGTTATCCGGAT

CATATGAAACGGCATGACTTTTTCAAGAGTGCCATGCCCGAAGGTTATGT

ACAGGAACGCACTATATCTTTCAAAGATGACGGGAACTACAAGACGCGTG

CTGAAGTCAAGTTTGAAGGTGATACCCTTGTTAATCGTATCGAGTTAAAA

GGTATTGATTTTAAAGAAGATGGAAACATTCTCGGACACAAACTCGAGTA

CAACTATAACTCACACAATGTATACATCACGGCAGACAAACAAAAGAATG

GAATCAAAGCTAACTTCAAAATTCGCCACAACATTGAAGATGGATCCGTT

CAACTAGCAGACCATTATCAACAAAATACTCCAATTGGCGATGGCCCTGT

CCTTTTACCAGACAACCATTACCTGTCGACACAATCTGCCCTTTCGAAAG

ATCCCAACGAAAGCGTGACCACATGGTCCTTCTTGAGTTTGTAACTGCT

GCTGGGATTACACATGGCATGGATGAGCTCTACAAAATTGGTGAAAGACA

ATATTGTGTTCCAGTTGATCAACCATGTTCTATTAATACTCAACCATGTT

GTGATGATGCTACTTGTACTCAAGAAAGAAATGAAAATGGACATACTGTT

TATTATTGTAGAGCTAAAGATGAGCTCTAA

The BGIH-ER expression ORF was cloned into the Pac I and Avr II restriction sites of the FECT expression vector to create a BGIH-ER expression vector for FECT transient plant expression system (pFECT-BGIH-ER), for ER-targeted expression of U-ACTX-Hv1a.

All three vectors, pFECT-BGIH, pFECT-GIH and pFECT-BGIH-ER, were transformed into the Agrobacterium strain, GV3101, and the resulting transformed GV3101 cells were used for transient transformation into the leaves of *Nicotiana benthamiana* using the methods described in Example 1. All of the three expression ORFs should transiently express a fusion protein, comprising GFP-fused U-ACTX-Hv1a with a trypsin cleavable linker between the two structural domains.

After 6 days of transient tobacco transformation, the expression of GFP-fused U-ACTX-Hv1a was examined initially by detection of green fluorescence under UV light. Green fluorescence was detected at various levels in all of the transformed tobacco leaves. The transformed leaves with CYTO targeted accumulation of GFP fused U-ACTX-Hv1a showed the strongest green fluorescence, and those leaves with APO or ER targeted fusion protein accumulation showed weaker green fluorescence. Thus, the results indicated that CYTO targeted expression may facilitate greater accumulation of transgenic GFP fused U-ACTX-Hv1a protein than the APO and ER targeted expression in tobacco leaves. In three replications of this experiment, the transformed tobacco leaves with CYTO targeted expression always showed green fluorescence similar to or stronger than that of the leaves with APO targeted expression, and the weakest green fluorescence was detected in the tobacco leaves transformed with the ER targeted constructs. These initial results indicated that CYTO targeted expression may accumulate as much or more transgenic fusion protein than APO targeted expression, and that ER targeted expression yielded the least accumulation.

Total soluble protein samples were extracted from tobacco leaves transformed with the different FECT vectors (protocol was described in detail in Example 1). Pierce Coomassie Plus protein assay was performed as in the description in Example 1 to determine the concentrations of the total soluble protein in the TSP extracts, yielding the following concentration estimates: 0.31±0.04 µg/µL, 0.31±0.03 µg/µL and 0.34±0.05 µg/µL for APO targeted, CYTO targeted and ER targeted expressions respectively (N=3).

The indirect ELISA protocol was then performed using the TSP extracts as described in Example 1 to quantitate the expression level of the U-ACTX-Hv1a protein as a percentage of total soluble protein (% TSP), yielding the following percentage estimates: 0.126±0.032%, 0.049±0.085% and 0.025±0.018% for APO targeted, CYTO targeted and ER targeted expressions respectively (N=3). FIG. 8 summarizes this quantification of expressed U-ACTX-Hv1a (as % TSP values) for the various transformed tobacco leaves described above. These results indicated that APO targeted transgene expression resulted in the greatest accumulation of correctly folded ICK motif protein expressed in the leaves.

Overall, although the tobacco leaves transformed to produce CYTO targeted, transgenic GFP fused U-ACTX-Hv1a presented the most potent green fluorescence signal, iELISA results detected the least U-ACTX-Hv1a peptide in these transgenic tobacco leaves, in fact, considerably less than what was detected for leaves transformed for ER targeted expression (which had weakest green fluorescence signal). In iELISA assays, the primary antibody (rabbit anti-U-ACTX-Hv1a antibody) can only bind on the correctly folded U-ACTX-Hv1a peptide.

Example 3

Alternate Signal Peptides for Expression of ICK Motif Proteins in Plants.

Since ER signal peptide may play a role in the protein expression level, two other ERSPs were tested using the FECT expression system described in the prior examples. The two ERSP candidates were tobacco extensin signal peptide, abbreviated as "E" in this study (Memelink et al, the Plant Journal, 1993, V4: 1011-1022), and one of its variants abbreviated as "E*" (Pogue G P et al, Plant Biotechnology Journal, 2010, V8: 638-654). Their amino acid sequences are listed below (N' to C', one letter code, with non-identical residues in bold font):

Extensin signal peptide
(SEQ ID NO: 18)
(EMGKMASLFASLLVVLVSLSLASESSA

Extensin signal peptide variant (E*):
(SEQ ID NO: 19)
MGKMASLFATFLVVLVSLSLASESSA A DNA sequence encoding E was designed for tobacco expression as follows:

(SEQ ID NO: 20)
ATGGGTAAGATGGCTTCTCTGTTTGCTTCTCTGCTGGTTGTTCTGGTTTC

TCTGTCTCTGGCTTCTGAATCTTCTGCT

The E DNA sequence was generated using oligo extension PCR with four synthetic DNA primers. Then, in order to add a Pac I restriction site at its 5' terminus and add part of 5' terminal DNA sequence of GFP at its 3' terminus, a further PCR was performed using the E DNA sequence as a template, yielding a 117 bp DNA fragment. This fragment was then used as the forward PCR primer to amplify the DNA sequence encoding the GFP-IGER linker-U-ACTX-Hv1a ORF from the vector pFECT-BGIH (refer to Example 1 and Example 2), thus producing a U-ACTX-Hv1a expression ORF encoding (from N' to C' terminus) extensin signal peptide-GFP-IGER linker-U-ACTX-Hv1a, following one of our ICK motif protein expression ORF design as ERSP-Sta-L-ICK. This expression ORF, named "EGIH", has a Pac I restriction site at its 5' terminus and Avr II restriction site at the 3' terminus. EGIH has the following DNA sequence:

(SEQ ID NO: 21)
TTAATTAAATGGGTAAGATGGCTTCTCTGTTTGCTTCTCTGCTGGTTGTT

CTGGTTTCTCTGTCTCTGGCTTCTGAATCTTCTGCTGCTAGCAAAGGAGA

AGAACTTTTCACTGGAGTTGTCCCAATTCTTGTTGAATTAGATGGTGATG

TTAATGGGCACAAATTTTCTGTCAGTGGAGAGGGTGAAGGTGATGCTACA

TACGGAAAGCTTACCCTTAAATTTATTTGCACTACTGGAAAACTACCTGT

TCCATGGCCAACACTTGTCACTACTTTCTCTTATGGTGTTCAATGCTTTT

CCCGTTATCCGGATCATATGAAACGGCATGACTTTTTCAAGAGTGCCATG

CCCGAAGGTTATGTACAGGAACGCACTATATCTTTCAAAGATGACGGGAA

CTACAAGACGCGTGCTGAAGTCAAGTTTGAAGGTGATACCCTTGTTAATC

GTATCGAGTTAAAAGGTATTGATTTTAAAGAAGATGGAAACATTCTCGGA

CACAAACTCGAGTACAACTATAACTCACACAATGTATACATCACGGCAGA

CAAACAAAAGAATGGAATCAAAGCTAACTTCAAAATTCGCCACAACATTG

AAGATGGATCCGTTCAACTAGCAGACCATTATCAACAAAATACTCCAATT

GGCGATGGCCCTGTCCTTTTACCAGACAACCATTACCTGTCGACACAATC

TGCCCTTTCGAAAGATCCCAACGAAAAGCGTGACCACATGGTCCTTCTTG

AGTTTGTAACTGCTGCTGGGATTACACATGGCATGGATGAGCTCTACAAA

ATTGGTGAAAGACAATATTGTGTTCCAGTTGATCAACCATGTTCTCTTAA

TACTCAACCATGTTGTGATGATGCTACTTGTACTCAAGAAAGAAATGAAA

ATGGACATACTGTTTATTATTGTAGAGCTTAACCTAGG

The EGIH DNA sequence was cloned into Pac I and Avr II restriction sites of the FECT vector to generate the pFECT-EGIH vector for transient plant expression of GFP fused U-ACTX-Hv1a protein.

A DNA sequence encoding the variant extensin signal peptide (E*) was designed for tobacco expression as follows:

(SEQ ID NO: 22)
ATGGGTAAGATGGCTTCTCTGTTTGCTACTTTTCTGGTTGTTCTGGTTTC

TCTGTCTCTGGCTTCTGAATCTTCTGCT

An "E*GIH" DNA sequence, which encoded a translational fusion of (listed from N' to C') variant extensin signal peptide-GFP-IGER linker-U-ACTX-Hv1a protein, was created using the same techniques as described above for the EGIH ORF. The resulting E*GIH ORF has the following DNA sequence:

(SEQ ID NO: 23)
TTAATTAAATGGGTAAGATGGCTTCTCTGTTTGCTACTTTTCTGGTTGTT

CTGGTTTCTCTGTCTCTGGCTTCTGAATCTTCTGCTGCTAGCAAAGGAGA

AGAACTTTTCACTGGAGTTGTCCCAATTCTTGTTGAATTAGATGGTGATG

TTAATGGGCACAAATTTTCTGTCAGTGGAGAGGGTGAAGGTGATGCTACA

TACGGAAAGCTTACCCTTAAATTTATTTGCACTACTGGAAAACTACCTGT

TCCATGGCCAACACTTGTCACTACTTTCTCTTATGGTGTTCAATGCTTTT

CCCGTTATCCGGATCATATGAAACGGCATGACTTTTTCAAGAGTGCCATG

CCCGAAGGTTATGTACAGGAACGCACTATATCTTTCAAAGATGACGGGAA

CTACAAGACGCGTGCTGAAGTCAAGTTTGAAGGTGATACCCTTGTTAATC

GTATCGAGTTAAAAGGTATTGATTTTAAAGAAGATGGAAACATTCTCGGA

CACAAACTCGAGTACAACTATAACTCACACAATGTATACATCACGGCAGA

CAAACAAAAGAATGGAATCAAAGCTAACTTCAAAATTCGCCACAACATTG

AAGATGGATCCGTTCAACTAGCAGACCATTATCAACAAAATACTCCAATT

GGCGATGGCCCTGTCCTTTTACCAGACAACCATTACCTGTCGACACAATC

TGCCCTTTCGAAAGATCCCAACGAAAAGCGTGACCACATGGTCCTTCTTG

AGTTTGTAACTGCTGCTGGGATTACACATGGCATGGATGAGCTCTACAAA

ATTGGTGAAAGACAATATTGTGTTCCAGTTGATCAACCATGTTCTCTTAA

TACTCAACCATGTTGTGATGATGCTACTTGTACTCAAGAAAGAAATGAAA

ATGGACATACTGTTTATTATTGTAGAGCTTAACCTAGG

The E*GIH DNA sequence was cloned into Pac I and Avr II restriction sites of the FECT vector to generate the pFECT-E*GIH vector for transient plant expression of GFP fused U-ACTX-Hv1a protein.

Three different FECT expression vectors, pFECT-BGIH, pFECT-EGIH and pFECT-E*GIH, were used to transiently express GFP fused U-ACTX-Hv1a protein in tobacco plants to evaluate how the protein expression level is affected by the different ERSPs. The three FECT expression vectors were transformed into Agrobacterium, GV3101, and then the transformed GV3101 was injected into tobacco leaves for transient expression of GFP fused U-ACTX-Hv1a protein in tobacco leaves using the techniques described in Example 1.

The expression levels of GFP fused U-ACTX-Hv1a from three different FECT expression vectors described above are first evaluated visually by detecting green fluorescence under UV light. Green fluorescence from the transiently transformed tobacco leaves from the three different FECT vectors is visible to the naked eye. All of the leaves showed similar levels of green fluorescence, suggesting that none of the three ERSPs tested contributed to a significant increase in the expression level of GFP fused U-ACTX-Hv1a protein.

Total soluble protein samples were extracted from the tobacco leaves transformed with the three ERSP FECT vectors as described above (protocol is described in detail in Example 1). Pierce Coomassie Plus protein assay was then performed (as described in Example 1) to determine the concentration of the total soluble protein in the resulting TSP samples, yielding values of 0.85±0.68 µg/µL, 0.70±0.47 µg/µL and 0.76±0.77 µg/µL for samples corresponding to the BGIH, EGIH and E*GIH expression ORFs respectively (N=4).

Indirect ELISA was then performed using the TSP extracts (as described in Example 1) to quantify the expression level of the U-ACTX-Hv1a protein as a percentage of the total soluble protein (% TSP), yielding values of 0.39±0.17% (N=3, as one data point was taken out as outliner), 0.48±0.26% (N=4), and 0.62±0.38% (N=4) for samples corresponding to the FECT vectors with BGIH, EGIH and E*GIH expression ORFs respectively. FIG. 9 summarizes the estimated U-ACTX-Hv1a levels as percentage in the total soluble protein (% TSP) for all of the samples taken from the tobacco leaves transformed with the three ERSP ORF described above. Although the data of % TSP from three FECT vector transformation looked different, they are not statistically different by Student's t-test. In other words, the three ERSPs did not make difference in the expression level of U-ACTX-Hv1a in the transiently transformed tobacco leaves.

Example 4

Stabilizing Protein Expressed as Fusion Protein to the ICK Motif Protein Helps the Accumulation of ICK Motif Protein in Transformed Plants.

The ICK motif protein for plant expression in this example was omega-ACTX-Hv1a, originating from the Australian Blue Mountains Funnel Web Spider, *Hadronyche versuta*. Omega-ACTX-Hv1a has the following amino acid sequence (one letter code):

```
                                       (SEQ ID NO: 24)
SPTCIPSGQPCPYNENCCSQSCTFKENENGNTVKRCD
```

The FECT expression system was used to express omega-ACTX-Hv1a in the tobacco plant, *Nicotiana benthamiana*. Two FECT vectors encoding different omega-ACTX-Hv1a expression ORFs were engineered. One of these expression ORFs encoded omega-ACTX-Hv1a with Barley Alpha-Amylase Signal peptide (BAAS) at its N' terminus without any stabilizing protein. This expression ORF, referred to herein as "BO", was subcloned to yield the FECT expression vector pFECT-BO. The other omega-ACTX-Hv1a expression ORF encodes a translational fusion of omega-ACTX-Hv1a to the protein Jun a 3The mature Jun a 3 is a ~30 kDa plant defending protein which is also an allergen for some people, is produced by *Juniperus ashei* trees and is used in this ORF as a translational stabilizing protein (STA.) Its amino acid sequence is listed below (one letter code):

```
                                       (SEQ ID NO: 25)
MARVSELAFLLAATLAISLHMQEAGVVKFDIKNQCGYTVWAAGLPGGG

KRLDQGQTWTVNLAAGTASARFWGRTGCTFDASGKGSCQTGDCGGQLS

CTVSGAVPATLAEYTQSDQDYYDVSLVDGFNIPLAINPTNAQCTAPAC

KADINAVCPSELKVDGGCNSACNVFKTDQVCCRNAVVDNCPATNYSKI

FKNQCPQAYSYAKDDTATFACASGTDYSIVFC
```

The mature Jun a 3 protein is provided below in SEQ ID NO: 26.

```
                                       (SEQ ID NO: 26)
KFDIKNQCGYTVWAAGLPGGGKRLDQGQTWTVNLAAGTASARFWGRTGCT

FDASGKGSCQTGDCGGQLSCTVSGAVPATLAEYTQSDQDYYDVSLVDGFN

IPLAINPTNAQCTAPACKADINAVCPSELKVDGGCNSACNVFKTDQVCCR

NAYVDNCPATNYSKIFKNQCPQAYSYAKDDTATFACASGTDYSIVFC
```

The ERSP encoded in the ORF of SEQ. ID. 25 is the Jun a 3 native signal peptide shown below as SEQ. ID 27.

```
                                       SEQ. ID. 27
MARVSELAFLLAATLAISLHMQEAGVV
```

The IGER linker, encoded by the sequence between the omega-ACTX-Hv1a domain and Jun a 3 domains that are encoded in the ORF, is described in detail in Example 1. Taken together, this omega-ACTX-Hv1a expression ORF is referred to as S-Juna3-IGER-Omega, or SJIO. Likewise, the FECT vector into which the SJIO expression ORF was inserted was named pFECT-SJIO.

The two omega-ACTX-Hv1a FECT expression vectors, pFECT-BO and pFECT-SJIO, were used to transiently express omega-ACTX-Hv1a protein in tobacco plants. The two FECT expression vectors were transformed into Agrobacterium strain GV3101, and the resulting GV3101 transformant was injected into tobacco leaves for transient expression of omega-ACTX-Hv1a in tobacco leaves using the techniques described in detail in Example 1.

At day 6 post-tobacco transformation, transformed tobacco leaves were collected and total soluble leaf proteins were extracted from the leaves (refer to Example 1 for detailed methods). Pierce Coomassie Plus protein assay was then performed to determine the concentrations of the total soluble leaf protein, yielding values of 3.047±0.176 µg/µL (N=2) and 2.473±0.209 µg/µL (N=2) for the leaves transformed with constructs encoding pFECT-SJIO and pFECT-BO respectively.

The indirect ELISA protocol was then performed using the TSP extracts above as described in Example 1 to quantitatively evaluate the expression level of the omega-ACTX-Hv1a protein as percentage of the total soluble protein (% TSP), yielding values of 0.133±0.014% (N=2) and 0.0004±0.0003% (N=2) for the leaves transformed with the pFECT-SJIO and pFECT-BO vectors respectively. These data indicated that omega-ACTX-Hv1a expressed as a translational fusion to Jun a 3 accumulated to a more than 300-fold higher steady state level than that of omega-ACTX-Hv1a expressed without translational fusion to the Jun a 3 protein.

The example 4 above, the function of the STA could also have been performed with snowdrop lectin (GNA) having the following sequence:

```
                                                   (SEQ ID NO: 28)
DNILYSGETLSTGEFLNYGSFVFIMQEDCNLVLYDVDKPIWATNTGGLSR

SCFLSMQTDGNLVVYNPSNKPIWASNTGGQNGNYVCILQKDRNVVIYGTD

RWATG
```

Example 5

A Cleavable Linker Between the Stabilizing Protein Domain and the ICK Motif Protein Domains in an ICK Motif Fusion Protein Expression ORF Enhances the Insecticidal Activity of the Resulting ICK Motif Protein Expressed in a Transgenic Plant.

Since most chewing insects secret trypsin into their guts to digest food, we designed a fusion protein expression ORF that encoded a trypsin cleavable linker between the stabilizing protein domain and the ICK motif protein domain of the fusion, in order to facilitate release of the ICK motif domain from the intact fusion protein in the insect gut.

The ICK motif protein for plant expression here was omega-ACTX-Hv1a, whose amino acid sequence is as follows (one letter code):

```
                                  (SEQ ID NO: 24)
SPTCIPSGQPCPYNENCCSQSCTFKENENGNTVKRCD
```

The omega-ACTX-Hv1a expression ORF that was used encodes a fusion protein comprising the following domains (N' to C'): Jun a 3 signal peptide:: Jun a 3:: IGER linker:: omega-ACTX-Hv1a, as in the structural formula ERSP-Sta-L-ICK described above. The origin and sequence of Jun a 3 is as described above in Example 4.

The ERSP used here was the Jun a 3 native signal peptide, as described above in Example 4.

The IGER linker, encoded by the sequence between the omega-ACTX-Hv1a domain and Jun a 3 domains that are encoded in the ORF, is described in detail in Example 1. Taken together, this omega-ACTX-Hv1a expression ORF is referred to as S-Juna3-IGER-Omega, or SJIO. Likewise, the FECT vector into which the SJIO expression ORF was inserted was named pFECT-SJIO.

The vector, pFECT-SJIO, was then used to transiently express omega-ACTX-Hv1a protein in tobacco plants. The vector was transformed into Agrobacterium, GV3101, and then the transformed GV3101 was injected into tobacco leaves for transient expression of omega-ACTX-Hv1a in the leaves using the techniques described in detail in Example 1.

Figure 10:
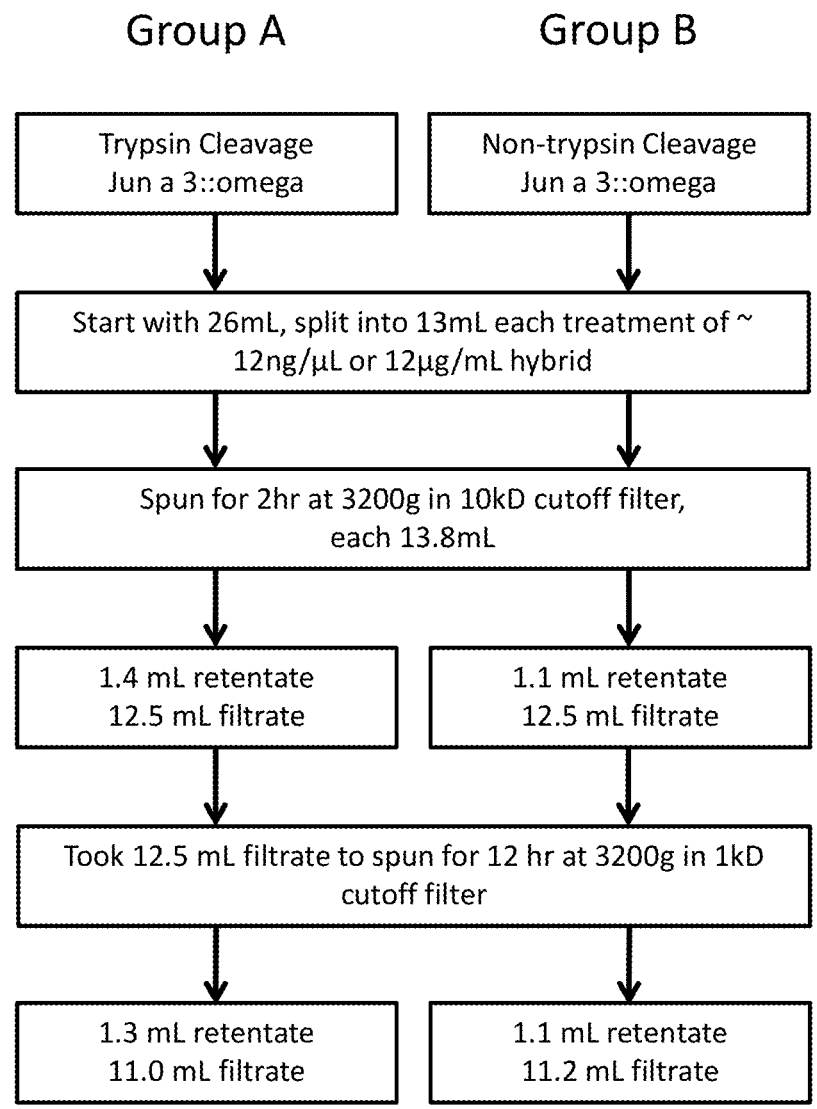
FIG. 10 is a diagram of the concentration process of trypsin treated and non-trypsin treated Jun a 3 fused Omega-ACTX-Hv1a protein extracted from the transiently transformed tobacco leaves.

On day 6 post tobacco leaf transformation, 3.3 g of transformed tobacco leaf was collected and ground in liquid nitrogen. 50 mL of TSP-Se1 buffer was used to extract the total soluble proteins (TSP) from the ground leaves by following the procedure described in Example 1. A total of 26 mL extract was recovered from the TSP extraction procedure, which was then evenly split into two samples, A and B, with 13 mL extract for each group. Sample A was treated with trypsin to release omega-ACTX-Hv1a from the fused Jun a 3 protein by adding 1.3 mL of 1 mg/mL trypsin in 1 mM HCl at 37° C. for 1 hour. Sample B was not treated by trypsin cleavage. To get omega-ACTX-Hv1a in the concentration range of bioactivity, both groups were concentrated in the same way as following. First, the extractions were loaded into a concentrator with 10 kD cutoff filter membrane and spun at 3200 g for 2 hours. Then 1.4 mL retentate from Sample A and 1.1 mL retentate from Sample B were saved for later tests. The 12.5 mL filtrate from Sample A and 12.5 mL filtrate from Sample B were further concentrated by being spun in concentrators with 1 kD cutoff filter membranes at 3200 g for 16 hours. 1.3 mL retentate was recovered from Sample A and 1.1 mL retentate was recovered from Sample B. Both 1 kD cutoff filtration retentates were saved for later tests. This sample concentration procedure was summarized in FIG. 10. The total TSP extraction from pFECT-SJIO transformed tobacco leaves was split evenly to two samples. One sample (A) was treated by trypsin cleavage and the other (B) was not. Both groups were concentrated by being spun in the concentrators with 10 kD and then 1 kD cutoff filter membranes, and the retentates from the 10 kD and 1 kD cutoff filtration were saved for further tests.

The SJIO expression ORF expressed a fusion protein as following, Jun a 3::IGER::Omega-ACTX-Hv1a, which comprises a total of 266 amino acid residues and has a predicted molecular weight of 28,204.28 Da. The trypsin cleavage of this fusion protein should release an omega-ACTX-Hv1a with molecular weight of 4049.2 Da and Jun a 3::IGER fusion protein with molecular weight of 24,155.1 Da. Therefore, if the trypsin cleavage reaction is complete in the treatment, then the anticipated major components of the filtration samples are as follows:

Sample A 10 kD filtration retentate: Jun a 3::IGER fusion.
Sample A 1 kD filtration retentate: Omega-ACTX-Hv1a.
Sample B 10 kD filtration retentate: Jun a 3::IGER::Omega-ACTX-Hv1a fusion.
Sample B 1 kD filtration retentate: no SJIO expressed protein.

To quantify the omega-ACTX-Hv1a peptide in the retentate samples, iELISA was performed as described in Example 1. The detected omega-ACTX-Hv1a concentrations in the samples were as follows:

Sample A 10 kD filtration retentate: 1.328 ng/μL of omega-ACTX-Hv1a, total 1.86 μg.
Sample A 1 kD filtration retentate: 2.768 ng/μL of omega-ACTX-Hv1a, total 3.60 μg.
Sample B 10 kD filtration retentate: 12.656 ng/μL of omega-ACTX-Hv1a, total 13.92 μg.
Sample B 1 kD filtration retentate: 0.752 ng/μL of omega-ACTX-Hv1a, total 0.83 μg.
As indicated, Omega-ACTX-Hv1a was detected in all filtration samples that were analyzed.
The detected omega-ACTX-Hv1a in the Group A 10 kD filtration retentate is presumably due in large part to physical retention of the uncleaved fusion protein. Likewise the omega-ACTX-Hv1a detected in the Group B 1 kD filtration retentate sample could be due to a low rate of spurious filtration of the uncleaved fusion protein through the 10 kD cutoff filter membrane.

Figure 11:
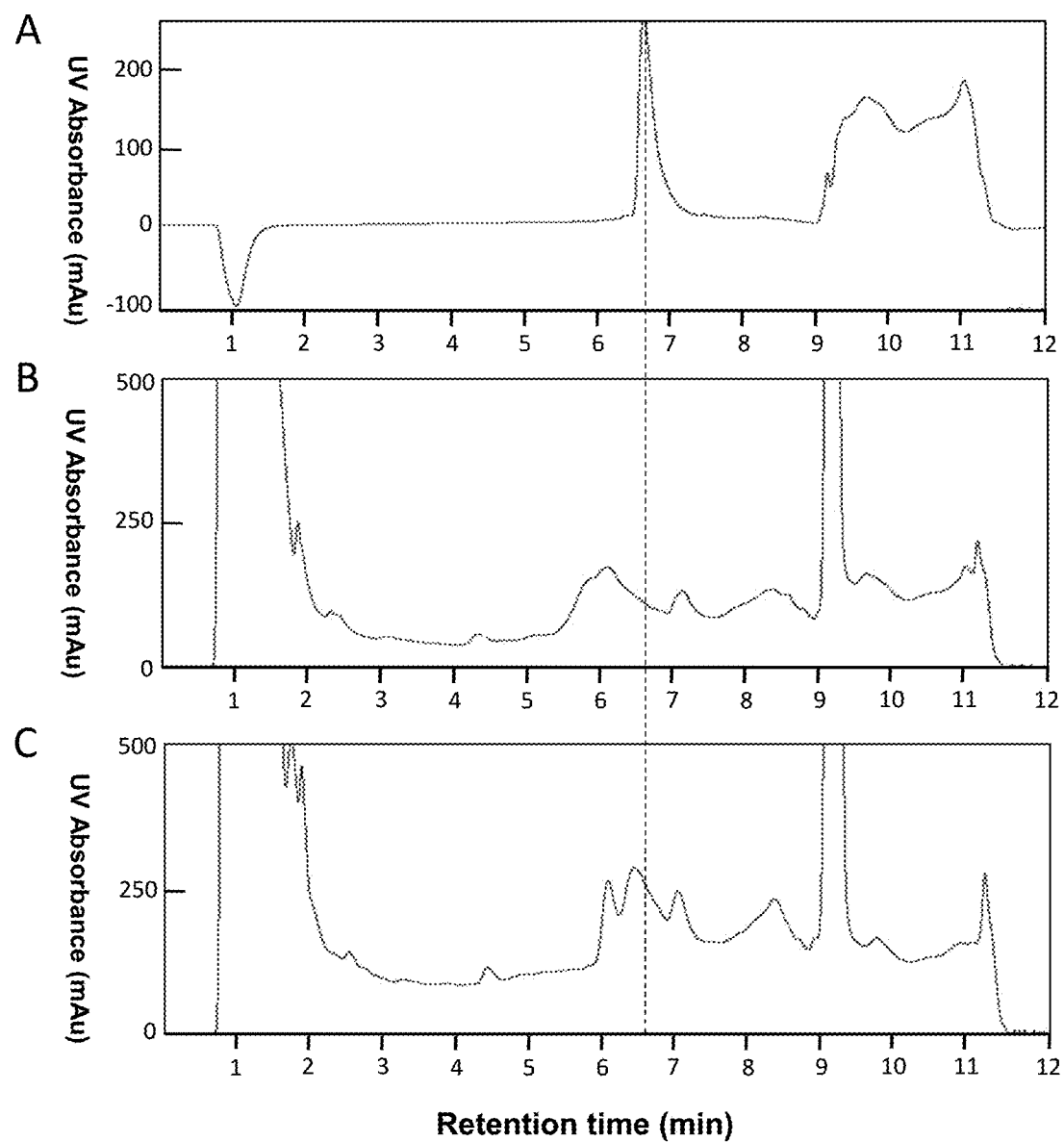
FIG. 11 is HPLC chromatographs for the samples containing omega-ACTX-Hv1a. Samples loaded on the HPLC system to produce the chromatographs were as follows: A. 25 μg synthetic omega-ACTX-Hv1a: B. 500 μL of Sample B 1 kD filtration retentate: C. 500 μL of Sample A 1 kD filtration retentate.

To confirm the trypsin-cleavage reaction was successful, reverse phase High Performance Liquid Chromatography (rpHPLC) was performed to analyze the components in the reserved filtration samples. HPLC was performed using a Varian E218 HPLC system with an Onyx 100 monolithic C18 column (4.6×100 mm), using water with 0.1% trifluoroacetic acid (solvent A) and acetonitrile with 0.1% trifluoroacetic acid (solvent B) as mobile phase components. The omega-ACTX-Hv1a peptide was eluted from the column at a flow rate of 2 mL per minute using a linear gradient of 10-20% solvent B over 10 minutes. Samples of 99% pure synthetic omega-ACTX-Hv1a were used in rpHPLC to produce a standard curve (relating peak area to mass of peptide injected). FIG. 11 shows three separate elution profiles, 11A, 11B, 11C. As shown in FIG. 11A, the omega-ACTX-Hv1a peptide eluted at 6.5 minutes post-injection. When a 500 µL sample from Group B 1 kD filtration retentate was loaded into the HPLC system, there was no protein peak between 6 and 7 minutes post-injection in the corresponding HPLC chromatograph (FIG. 11B). When a 500 µL sample from Group A 1 kD filtration retentate was loaded into the HPLC system, there was a peak at retention time of 6.3 minute (see dotted line in FIG. 11) in the corresponding chromatograph, representing omega-ACTX-Hv1a released from the fusion protein by trypsin cleavage (FIG. 11C). The area of this peak corresponded to a concentration of omega-ACTX-Hv1a of between 16-70 ng/µL in the Sample A 1 kD filtration retentate (depending on the approach used to integrate the peak).

The reserved filtration samples were used to perform housefly injection bioassays to test the activity of the omega-ACTX-Hv1a in the fusion protein form and in the released form from the fusion protein. Housefly pupae (*Musca domestica*) were purchased from Benzon Research, Inc. and kept at 25° C. in a plastic box with air holes on the box lid and fly food (1:1 ratio sugar and powder milk) and cotton balls soaked in water in the box. On the day after adult housefly emergence, the flies were immobilized using a $CO_2$ line and then kept immobile using a $CO_2$ infusion pad. Flies weighing 12-18 mg were selected for the injection bioassay. To perform housefly injection, a microapplicator loaded with a 1 cc glass syringe with a 30 gauge needle, in which the injection solution was loaded, was used to deliver 0.5 µL doses into the dorsal thorax of the flies. The injected flies were then put into labeled boxes with air holes, and mortality was scored 24 hours post-injection. The following samples were injected into houseflies (groups of 10 flies were used for each sample):

Water injection as negative control.
Group A 10 kD filtration retentate.
Group A 1 kD filtration retentate.
Group B 10 kD filtration retentate.
Group B 1 kD filtration retentate.
0.13 mg/mL trypsin solution as negative control.

At 24 hrs. post injection, the Sample A 10 kD filtration retentate and Sample A 1 kD filtration retentate caused 100% housefly mortality, while 0% mortality was observed for the flies injected with the other samples. Pure, native sequence omega-ACTX-Hv1a showed an $LD_{50}$ of 100 pmol/gram of housefly in this housefly injection bioassay; hence, to generate 100% mortality in this paradigm, the concentration of the injected omega-ACTX-Hv1a must at least 25 ng/µL. This is consistent with the bioassay results, since HPLC analysis of the Sample A 1 kD filtration retentate indicated a concentration of concentration of omega-ACTX-Hv1a of 16-70 ng/µL. Filtration samples that did not comprise material that was treated with trypsin cleavage did not generate mortality in the housefly injection bioassay, indicating that the Jun a 3 fused omega-ACTX-Hv1a was considerably less active than native-sequence omega-ACTX-Hv1a cleaved away from the fusion construct by trypsin. Therefore, the linker region of a plant ICK motif protein expression ORF can show enhanced insecticidal function when designed to be cleavable, such that the ICK motif domain of the ICK fusion protein can be released from the other structural domains of the protein by proteolysis.

Part I. High Production Peptides

The ability to successfully produce insecticidal peptides on a commercial scale, with reproducible peptide formation and folding, and with cost controls can be challenging. The wide variety, unique properties and special nature of peptides, combined with the huge variety of possible productions techniques can present an overwhelming number of approaches to peptide production.

There are few if any descriptions, however, that describe how to change a peptide so that it will be produced in a biological system at a much higher rate of production than the peptide is typically produced before it is changed. Here we present a way to change the composition of a peptide and in so doing increase the rate and amount and simultaneously lower the cost of peptide production. We describe novel ways of changing or "converting" one peptide into a different, more cost effective peptide, yet one which surprisingly is just as toxic as before it was converted.

We describe examples of these novel converted peptides, and we show how these methods for altering or converting a peptide can make a significant improvement in the yield of peptides without making significant changes in its activity. The new processes, new peptides, new formulations, and new organisms for producing those peptides are described and claimed herein. A process is described which increases the insecticidal peptide production yield from yeast expression systems by adding a dipeptide at the N terminus of insecticidal peptides. The addition of a dipeptide does not adversely affect the insecticidal activities of insecticidal peptides.

We describe examples of these novel converted peptides, and we show how these methods for altering or converting a peptide can make a significant improvement in the yield of peptides without making significant changes in its activity. The new processes, new peptides, new formulations, and new organisms for producing those peptides are described and claimed herein.

Detailed procedures for making high production peptides.

We describe a process and peptide that can increase peptide production. When followed these techniques will provide a converted peptide by adding a dipeptide at the N-terminus of the native peptide that has better production rate than the native peptide in three different ways. First, the over-all average yield of the dipeptide-native peptide strains is better than that of the native strains; second, the median yield of the dipeptide-native peptide strains is better than that of the native; and third, there are more dipeptide strains at the higher yield range than there are for native peptide strains. The process described here can be used in various in vivo systems, including plants, animals and microbes. The invention requires the addition of a dipeptide to the N-terminus of the native peptide, which is the peptide that was known before the dipeptide is added. The known peptide is then "converted", and it can then be made with greater yields than were previously thought possible. In one embodiment insecticidal peptides are linked to a dipeptide. These dipeptide-native peptide systems can be used in plants that can produce the peptides. Plant produced peptides have a variety of uses from production to simply making a toxic peptide available for consumption by a damaging insect, thus either protecting the plants or possibly providing other benefits.

In one embodiment we describe a process for increasing insecticidal peptide production yield in yeast expression systems by the addition of any dipeptide to the N-terminus of the insecticidal peptide. The dipeptide is composed of a non-polar amino acid and a polar amino acid. The non-polar amino acid may be selected from glycine, alanine, proline, valine, leucine, isoleucine, phenylalanine and methionine.

Glycine is the preferred non-polar amino acid. The polar amino acid may be selected from serine, threonine, cysteine, asparagine, glutamine, histidine, tryptophan and tyrosine. Serine is the preferred polar amino acid. The process and amino acids are described where the non-polar amino acid is at the N-terminus of the dipeptide and in one embodiment the preferred N-terminus of the dipeptide is glycine. The process and amino acids are described where the polar amino acid is at the C-terminus of the dipeptide and in one embodiment the preferred C-terminus of the dipeptide is serine.

In one embodiment of the invention the dipeptide is glycine-serine, gly-ser or GS. These amino acids are typically encoded by the following codons: Gly may be encoded by codons such as GGT, GGC, GGA, GGG and Ser may be encoded by codons such as TCT, TCC, TCA, TCG, AGT, and AGC.

The transgenes of the insecticidal peptides are designed such that their transgene sequences are optimized for the specific expression that may be needed. For example, the transgenes of insecticidal peptides may be optimized for expression in yeast, plants, bacteria, and viruses. Examples of such uses of the invention would include the engineering and optimization of transgenes for crops like maize and soybean, with the purpose of protecting them from insect pests. In one example we design transgenes of insecticidal peptides such that their transgene sequences are optimized for the specific expression in yeast expression systems, using for example, *Kluyveromyces lactis, Pichia pastoris*, and *Saccharomyces cerevisiae*. Other suitable yeast expression systems are known in the art. The nucleotide codons for a dipeptide, such as glycine-serine, (gly-ser) are added to the 5' end of the transgene sequences of the mature insecticidal peptides. The transgene sequences are then ligated into appropriate expression vectors, which can provide appropriate selection markers, strong promoter-terminator sets for the specific yeast expression system, signal sequences for secretion, and cleavage sites between the respective signal sequences and mature peptide sequences. The insecticidal peptide expression vectors are then transformed into yeast cells, by means known to one skilled in the art, including either electroporation or chemical transformation methods, in order to generate stable peptide expression yeast strains. When these yeast strains grow in appropriate media, they produce insecticidal peptides modified by the addition of a dipeptide sequence, glycine-serine, to the N-terminus of the mature insecticidal peptides, which are secreted into the growth media. The addition of the dipeptide, glycine-serine, to the N-terminus of the mature insecticidal peptides, significantly improves the yield of the insecticidal peptides without adverse effects on the insecticidal activities of the peptides.

Our data shows that any Cysteine Rich Insecticidal Peptide (CRIP) can be made to grow at significantly higher yields than would otherwise be possible using the procedures we describe here. We have demonstrated the both ICK and non ICK types of CRIPs can have their yields dramatically improved using the High Production techniques we described. Here we provide evidence of dramatic and surprising increases in yields of two very diverse types of CRIPS.

The insecticidal peptides that can be converted may be selected from insecticidal venom, for example the venom of a spider. The spider may be an Australian funnel web spider. The peptides from the genus of *Atrax* or *Hadronyche* are U-ACTX-Hv1a and its analogs and are easily made special using the procedures described herein. Specific peptide examples from spiders are described in the sequence listing provided herein. These peptides and others can be converted using the procedures described herein.

The insecticidal peptides that can be converted may be selected from sea anemone toxins such as from *Anemone viridis* as described in Example 3. Sea anemones are far removed in their normal habitat from the funnel web spiders of the genus of *Atrax* or *Hadronyche* and the venom from *Anemone viridis* is not considered a ICK type of venom, as is venomous peptides from *Atrax* or *Hadronyche* but in spite of that the venom of the sea urchin, like the U-ACTX-Hv1a toxic peptides and other insecticidal venoms is that they are all a type of venom that we call Cysteine Rich Insecticidal Peptide or CRIP and identified here for the first time as such. The procedures described herein, in all the sections, are expected and believed to work with all of the peptide in the sequence listings and all of the peptides related to those sequences that would be understood by one skilled in the art to be a Cysteine Rich Insecticidal Peptide or CRIP. All such peptides and others can be converted using the procedures described herein.

In addition to the process, we also disclose novel High Production Peptides, herein "HP peptides," comprising a dipeptide bound to one end of a peptide. In our embodiments the peptide is an insecticidal peptide. In one embodiment the dipeptide is added to the N-terminus of the peptide. We have demonstrated success in producing high yield strains with both ICK and non-ICK CRIP peptides. In a further embodiment the dipeptide is composed of a non-polar amino acid and a polar amino acid. In a further embodiment the non-polar amino acid is selected from glycine, alanine, proline, valine, leucine, isoleucine, phenylalanine and methionine, and the polar amino acid is selected from serine, threonine, cysteine, asparagine, glutamine histidine, tryptophan and tyrosine. In one specific embodiment an HP peptide is comprised of a peptide which is modified to have the dipeptide of glycine-serine as the first two amino acids of an otherwise unmodified, mature peptide. HP peptides may be produced by adding glycine-serine to the U peptide and its analogs to create HP peptides.

The modified peptides made by the processes described herein are new and are separately claimed. These peptides are described by all of their properties and not simply their sequence. These peptides are novel and have unique properties. Both HP peptides and the process of making them are disclosed and claimed herein.

Examples of useful peptides are well known and can be found in numerous references. One class of useful peptides is insecticidal peptides. Insecticidal peptides can be identified by their peptide nature and their activity, usually oral or injection insecticidal activity. Here we provide a few examples to better illustrate and describe the invention, but the invention is not limited to these examples. All of these examples and others not shown here are descriptive of new materials, described and claimed here for the first time.

HP (High Production) peptides are defined here as any peptides capable of being produced at greater than normal rates of production using the techniques described herein. Such peptides may have insecticidal activity. Typically, insecticidal peptides show activity when injected into insects but most do not have significant activity when applied to an insect topically. The insecticidal activity of HP peptides is measured in a variety of ways.

Common methods of measurement are widely known to those skilled in the art. Such methods include, but are not limited to determination of median response doses (e.g., $LD_{50}$, $PD_{50}$, $LC_{50}$, $ED_{50}$) by fitting of dose-response plots based on scoring various parameters such as: paralysis, mortality, failure to gain weight, etc. Measurements can be made for cohorts of insects exposed to various doses of the insecticidal formulation in question. Analysis of the data can be made by creating curves defined by probit analysis and/or the Hill Equation, etc. In such cases, doses would be administered by hypodermic injection, by hyperbaric infusion, by presentation of the insecticidal formulation as part of a sample of food or bait, etc.

Specific examples of HP peptides disclosed for purposes of providing examples and not intended to be limiting in any way, are the U peptide and its homologies, which origin from the venoms of Australian Funnel-web spiders. The description of these peptides can be found in this document in earlier sections.

The Examples in this specification are not intended to, and should not be used to limit the invention, they are provided only to illustrate the invention.

As noted above, many peptides are suitable candidates as the subject of the process to make special. The sequences noted above, below and in the sequence listing are especially suitable peptides that can be made special, and some of these have been made special according to this invention with the results shown in the examples below.

(one letter code)
SEQ ID NO: 5
GSQYC VPVDQ PCSLN TQPCC DDATC TQERN ENGHT VYYCR A.

Named "U+2-ACTX-Hv1a," It has disulfide bridges at positions: 5-20, 12-25, 19-39. The molecular weight is 4564.85 Daltons.

(one letter code)
SEQ ID NO: 29
GSRSC CPCYW GGCPW GQNCY PEGCS GPKV.

Named "Av3+2," It has disulfide bridges at positions: 5-19, 6-13, 8-24. The molecular weight is 3076.47 Daltons.

Preparation of the HP Peptides

The HP peptides described herein can be prepared as below. The open reading frames (ORFs) of the insecticidal peptides are designed such that their nucleotide sequences are optimized for species-specific expression. Shown below is a specific example of a process for increasing insecticidal peptide production yield from yeast expression systems by addition of a dipeptide to the N-terminus of the insecticidal peptide. The dipeptide is composed of a non-polar amino acid and a polar amino acid. The non-polar amino acid may be selected from glycine, alanine, proline, valine, leucine, isoleucine, phenylalanine and methionine and glycine is the preferred non-polar amino acid. The polar amino acid may be selected from serine, threonine, cysteine, histidine, tryptophan, tyrosine, asparagine and glutamine and serine is the preferred polar amino acid. In the example below, the non-polar amino acid is at the N-terminus of the dipeptide and it is glycine. In the example below, the polar amino acid is at the C-terminus of the dipeptide and it is serine.

The insecticidal peptide ORF is designed for secretion from host yeast cells as follows: the ORF starts with a signal peptide sequence, followed by DNA sequence encoding a Kex 2 cleavage site (Lysine-Arginine), followed by the insecticidal peptide transgene with addition of glycine-serine codons at the 5' terminus, and finally ends with a stop codon at the 3' terminus. All these elements will be expressed to a fusion peptide in yeast cells as a single open reading frame. An α-mating factor signal sequence is most frequently used to facilitate metabolic processing of the recombinant insecticidal peptides through the endogenous secretion pathway of the recombinant yeast, i.e. the expressed fusion peptide will typically enter the Endoplasmic Reticulum, wherein the α-mating factor signal sequence is removed by signal peptidase activity, and then the resulting pro-insecticidal peptide will be trafficked to the Golgi Apparatus, in which the Lysine-Arginine dipeptide mentioned above is completely removed by Kex 2 endoprotease, after which the mature, HP insecticidal peptide, comprising the additional non-native glycine-serine dipeptide at its N-terminus, is secreted out of the cells.

To enhance insecticidal peptide expression level in the recombinant yeast cells, the codons of the insecticidal peptide ORF are usually optimized for expression in the specific host yeast species. Naturally occurring frequencies of codons observed in endogenous open reading frames of a given host organism are not necessarily optimized for high efficiency expression. Furthermore, different yeast species (for example, *Kluyveromyces lactis, Pichia pastoris, Saccharomyces cerevisiae*, etc.) have different optimal codons for high efficiency expression. Hence, codon optimization should be considered for the peptide ORF, including the sequence elements encoding the signal sequence, the Kex2 cleavage site and the insecticidal peptides, since they are initially translated as one fusion peptide in the recombinant yeast cells.

The codon-optimized peptide expression DNAs are then ligated into appropriate expression vectors for yeast expression. There are many expression vectors available for yeast expression, including episomal vectors and integrative vectors, and they are usually designed for specific yeast strains. One should carefully choose the appropriate expression vector in view of the specific yeast expression system which will be used for the peptide production. Here we used integrative vectors, which will integrate into chromosomes of the transformed yeast cells and be stable through cycles of cell division and proliferation.

The expression vectors usually contain some *E. coli* elements for DNA preparation in *E. coli*, for example, *E. coli* replication origin, antibiotic selection marker, etc. The vectors also contain an array of the sequence elements needed for expression of the transgene of interest, for example, transcriptional promoters, terminators, yeast selection markers, integrative DNA sequences homologous to host yeast DNA, etc. There are many suitable yeast promoters available, including natural and engineered promoters. In our efforts, yeast promoters such as pLAC4, pAOX1, pUPP, pADH1, pTEF, pGal1, etc. have been used. We also used the following commonly used yeast selection markers: acetamide prototrophy selection, zeocin-resistance selection, geneticin-resistance selection, nourseothricin-resistance selection, uracil deficiency selection. Other markers known to one skilled in the art could also be used. The integrative DNA sequences are homologous to targeted genomic DNA loci in the transformed yeast species, and such integrative sequences include pLAC4, 25S rDNA, pAOX1, and TRP2, etc. The locations of insecticidal peptide transgenes can be adjacent to the integrative DNA sequence (Insertion vectors) or within the integrative DNA sequence (replacement vectors).

To get more copies of insecticidal peptide ORF integrated into the host yeast chromosomes, the expression vectors can be designed and generated to contain two or three copies of insecticidal peptide expression cassette. Each copy of the insecticidal peptide expression cassette in the expression vector should contain independent and complete expression structures including promoter, signal sequence, Kex2 cleavage sequence and, the insecticidal peptide transgene, stop codon transcription terminator.

The peptide expression vectors are then transformed into yeast cells. First, the expression vectors are usually linearized by specific restriction enzyme cleavage to facilitate chromosomal integration via homologous recombination. The linear expression vector is then transformed into yeast cells by a chemical or electroporation method of transformation and integrated into the targeted locus of the yeast genome by homologous recombination. The integration can happen at the same chromosomal locus multiple times; therefore the genome of a transformed yeast cell can contain multiple copies of insecticidal peptide transgenes. The successful transformants can be identified using growth conditions that favor a selective marker engineered into the expression vector and co-integrated into yeast chromosomes with the insecticidal peptide transgenes; examples of such markers include, but aren't limited to, acetamide prototrophy, zeocin resistance, geneticin resistance, nourseothricin resistance, and uracil prototrophy.

Due to the influence of unpredictable and variable factors—such as epigenetic modification of genes and networks of genes, and variation in the number of integration events that occur in individual cells in a population undergoing a transformation procedure—individual yeast transformants of a given transformation process will differ in their capacities to produce a transgenic insecticidal peptide. Therefore, yeast transformants carrying the insecticidal peptide transgenes should be screened for high yield strains. Two effective methods for such screening, each dependent on growth of small-scale cultures of the transformants to provide conditioned media samples for subsequent analysis, use reverse-phase HPLC or housefly injection procedures to analyze conditioned media samples from the transformants.

The transformant cultures are usually performed in 14 mL round bottom polypropylene culture tubes with 5-10 mL defined medium added to each tube, or in 48-well deep well culture plates with 1-2 mL defined medium added to each well. The Defined medium, not containing crude proteinaceous extracts or by-products such as yeast extract or peptone, is used for the cultures to reduce the protein background in the conditioned media harvested for the later screening steps. The cultures are performed at the optimal temperature, for example, 23.5° C. for *K. lactis*, for 5-6 days, until the maximum cell density is reached. The insecticidal peptides are now produced from the transformants and secreted out of cells to the growth medium. To prepare samples for the screening, cells are removed from the cultures by centrifugation and the supernatants are collected as the conditioned media, which are then cleaned by filtration through 0.22 μm filter membrane and then made ready for insecticidal peptide production strain screening, a couple of examples of such screening methods are described below.

One of the screening methods is reverse-phase HPLC (rpHPLC) screening of transformants. In this screening method, an HPLC analytic column with bonded phase of C18 is used. Acetonitrile and water are used as mobile phase solvents, and a UV absorbance detector set at 220 nm is used for the peptide detection. Appropriate amounts of the conditioned medium samples are loaded into the rpHPLC system and eluted with a linear gradient of mobile phase solvents. The corresponding peak area of the insecticidal peptide in the HPLC chromatograph is used to quantify the insecticidal peptide concentrations in the conditioned media. Known amounts of pure insecticidal peptide are run through the same rpHPLC column with the same HPLC protocol to confirm the retention time of the peptide and to produce a standard peptide HPLC curve for the quantification.

A second screening method is the housefly injection assay. Insecticidal peptide can kill houseflies when injected in measured doses through the body wall of the dorsal thorax. The efficacy of the insecticidal peptide can be defined by the median lethal dose of the peptide (LD50), which causes 50% mortality of the injected houseflies. The pure insecticidal peptide is normally used in the housefly injection assay to generate a standard dose-response curve, from which an LD50 value can be determined. Using an LD50 value from the analysis of a standard dose-response curve of the pure insecticidal peptide in question, quantification of the insecticidal peptide produced by a yeast transformant can be achieved using a housefly injection assay performed with serial dilutions of the corresponding conditioned media.

The insecticidal peptide production strain screen can identify the high yield yeast strains from hundreds of transformants. These strains can be fermented in bioreactor to achieve up to 6 g/L yield of the insecticidal peptides when using optimized fermentation media and fermentation conditions. The higher rates of production can be anywhere from 20 to 400, 20 to 100, 20 to 200, 20 to 300, 40 to 100, 40 to 200, 40 to 300, 40 to 400, 60 to 100, 60 to 200, 60 to 300, 60 to 400, 80 to 100, 80 to 200, 80 to 300, 80 to 400, 100 to 150, 100 to 200, 150 to 200, 200 to 250, 250 to 300, 250 to 350, 250 to 400, 300 to 350, 300 to 400% and 350 to 400 or any range of any value provided or even greater yields than can be achieved with a peptide before conversion, using the same or similar production methods that were used to produce the peptide before conversion.

Any of the sequences from the sequence listing, and as far as we know any CRIP could all be used to make high production peptides similar to either the ACTX motifs from the Australian Blue Mountain Funnel-web Spider we call the "U+2" peptide described below, or the Av3+2 peptide of the toxic sea anemone, *Anemone viridis*, that we teach and describe in the examples below by using procedures taught here and the knowledge of one ordinarily skilled in the art. In addition, any other suitable CRIP peptide could be used in a like manner to produce a high production or plus 2, i.e. +2 peptide.

Examples of High Production Peptides

The Examples in this specification are not intended to, and should not be used to limit the invention, they are provided only to illustrate the invention.

Example 1

Expression of native U and U+2-ACTX-Hv1a in *Kluyveromyces lactis* (*K. lactis*).
Insecticidal Peptides to Express:

```
U + 2-ACTX-Hv1a:
                                      (SEQ ID NO: 5)
GSQYCVPVDQPCSLNTQPCCDDATCTQERNENGHTVYYCRA
and Native U-ACTX-Hv1a:
                                      (SEQ ID NO: 6)
QYCVPVDQPCSLNTQPCCDDATCTQERNENGHTVYYCRA
```

To express the two insecticidal peptides above in *K. lactis*, the expression vector, pKLAC1, and the *K. lactis* strain, YCT306, were used, which are available from New England Biolabs, Ipswich, MA, USA. pKLAC1 vector is an integrative expression vector. Once the U+2 and native U-ACTX-Hv1a transgenes were cloned into pKLAC1 and transformed into YCT306, their expression was controlled by the LAC4 promoter. The resulting transformants produced pre-propeptides comprising an α-mating factor signal peptide, a Kex2 cleavage site and mature insecticidal peptides. The α-Mating factor signal peptide guides the pre-propeptides to go through the endogenous secretion pathway and finally the mature insecticidal peptides are released into the growth media.

Codon optimization for U+2-ACTX-Hv1a expression was performed in two rounds. In the first round, based on some common features of high expression DNA sequences, 33 variants of the peptide ORF, expressing an α-Mating factor signal peptide, a Kex2 cleavage site and the U+2-ACTX-Hv1a peptide, were designed and their expression levels were evaluated in the YCT306 strain of $K.$ $lactis$, resulting in an initial $K.$ $lactis$ expression algorithm. In the $2^{nd}$ round of optimization, five more variant U+2-ACTX-Hv1a peptide ORFs were designed based on the initial $K.$ $lactis$ expression algorithm to further fine-tune the $K.$ $lactis$ expression algorithm, and identified the best ORF for the U+2-ACTX-Hv1a peptide expression in $K.$ $lactis$. This DNA sequence has an open reading frame encoding an α-mating factor signal peptide, a Kex2 cleavage site and a U+2-ACTX-Hv1a peptide. The optimized DNA sequence was cloned into the pKLAC1 vector using Hind III and Not I restriction sites, resulting in the U+2-ACTX-Hv1a expression vector, pLB10V5.

To enable integration of more copies of the optimized U+2-ACTX-Hv1a transgene into the $K.$ $lactis$ genome during transformation, generation of a U+2-ACTX-Hv1a expression vector containing two copies of U+2-ACTX-Hv1a expression cassette was processed as follows: A 3,306 bp intact U+2-ACTX-Hv1a expression cassette DNA sequence was synthesized, which comprised an intact LAC4 promoter element, a codon-optimized U+2-ACTX-Hv1a peptide ORF element and a pLAC4 terminator element. This intact expression cassette was then ligated into the pLB10V5 vector between Sal I and Kpn I restriction sites, downstream of the pLAC4 terminator of pLB10V5, resulting in the double transgene U+2-ACTX-Hv1a expression vector, pLB10V5D.

To generate a native U-ACTX-Hv1a expression vector, the pLB10V5 vector was mutagenized by deleting the glycine-serine codons at the 5'-terminus of the U+2-ACTX-Hv1a transgene region, using a Stratagene site-direct mutagenesis kit. This mutagenesis resulted in a new vector, pLB12, containing a single copy of the codon-optimized native U-ACTX-Hv1a expression cassette. To generate a double transgene native U-ACTX-Hv1a expression vector, a Stratagene site-direct mutagenesis kit was used again to remove the glycine-serine codons at the 5'-terminus of the U+2-ACTX-Hv1a transgene region in the 3,306 bp U+2-ACTX-Hv1a expression cassette transgene synthesized previously, followed by ligation to insert the mutagenized cassette into the pLB12 vector between Sal I and Kpn I restriction sites, resulting in the plasmid, pLB12D, an expression vector comprising two intact copies of the codon-optimized native U-ACTX-Hv1a expression cassette.

The double transgene vectors, pLB10V5D and pLB12D, were then linearized using Sac II restriction endonuclease and chemically transformed into YCT306 strain of $K.$ $lactis$, according to instructions provided with a $K.$ $lactis$ Protein Expression Kit. The resulting transformants grew on YCB agar plate supplemented with 5 mM acetamide, which only the acetamidase-expressing transformants could use efficiently as a metabolic source of nitrogen.

For insecticidal peptide yield evaluations, 316 colonies were picked from the pLB10V5D transformants plates, and 40 colonies were picked from the pLB12D transformants plates. Inocula from the colonies were each cultured in 6 mL of the defined $K.$ $lactis$ media with 2% pure glycerol added as a carbon source. Cultures were incubated at 23.5° C., with shaking at 280 rpm, for six days, at which point cell densities in the cultures had reached their maximum levels as indicated by light absorbance at 600 nm (OD600). Cells were then removed from the cultures by centrifugation at 4,000 rpm for 10 minutes. The resulting supernatants (conditioned media) were filtered through 0.2 m membranes for HPLC yield analysis.

For the peptide yield evaluation, the filtered conditioned media samples were analyzed on an Agilent 1100 HPLC system equipped with an Onyx monolithic 4.5×100 mm, C18 reverse-phase analytical HPLC column and an autoinjector. HPLC grade water and acetonitrile, both containing 0.1% trifluoroacetic acid, constituted the two mobile phase solvents used for the HPLC analyses. The peak areas of both the native U and U+2-ACTX-Hv1 were measured using HPLC chromatographs and then used to calculate the peptide concentration in the conditioned media, which were then further normalized to the corresponding final cell densities (as determined by OD600 measurements) as normalized peptide yield.

Housefly injection bioassay was used to evaluate the insecticidal activity of the peptides. The conditioned media were serially diluted to generate full dose-response curves from the housefly injection bioassay. Before injection, adult houseflies (Musca domestica) were immobilized with $CO_2$, and 12-18 mg houseflies were selected for injection. A microapplicator, loaded with a 1 cc syringe and 30-gauge needle, was used to inject 0.5 μL per fly doses of serially diluted conditioned media samples into houseflies through the body wall of the dorsal thorax. The injected houseflies were placed into closed containers with moist filter paper and breathing holes on the lids, and they were examined by mortality scoring at 24 hours post-injection.

Normalized yields were calculated. Peptide yield means the peptide concentration in the conditioned media in units of mg/L. But peptide yields are not always sufficient to accurately compare the strain production rate. Individual strains may have different growth rates, hence when a culture is harvested, different cultures may vary in cell density. A culture with a high cell density may produce a higher concentration of the peptide in the media, even though the peptide production rate of the strain is lower than another strain which has a higher production rate. So the term "normalized yield" is created by dividing the peptide yield with the cell density in the corresponding culture and this allows a better comparison of the peptide production rate between strains. The cell density is represented by the light absorbance at 600 nm with a unit of "A" (Absorbance unit).

Figure 12:
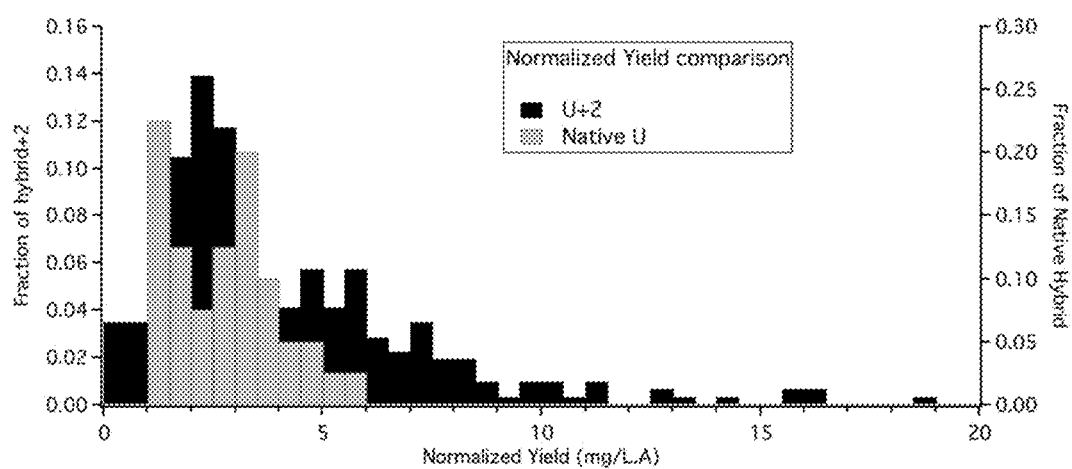
FIG. 12 is a graphical representation of the distribution of the normalized peptide yields of both U+2-ACTX-Hv1a (sometimes referred to herein as "U+2") and native U-ACTX-Hv1a (sometimes referred to herein as "native U"), produced in Kluyveromyces lactis (K. lactis) strains. The U+2 data is shown in black and the native U data is in gray. The x-axis shows the normalized yield in units of milligrams per liter per light absorbance unit at wavelength of 600 nm (mg/L.A.) The left y-scale shows the fraction of U+2 strains. The right y-scale shows the fraction of native U strains.
Figure 13:
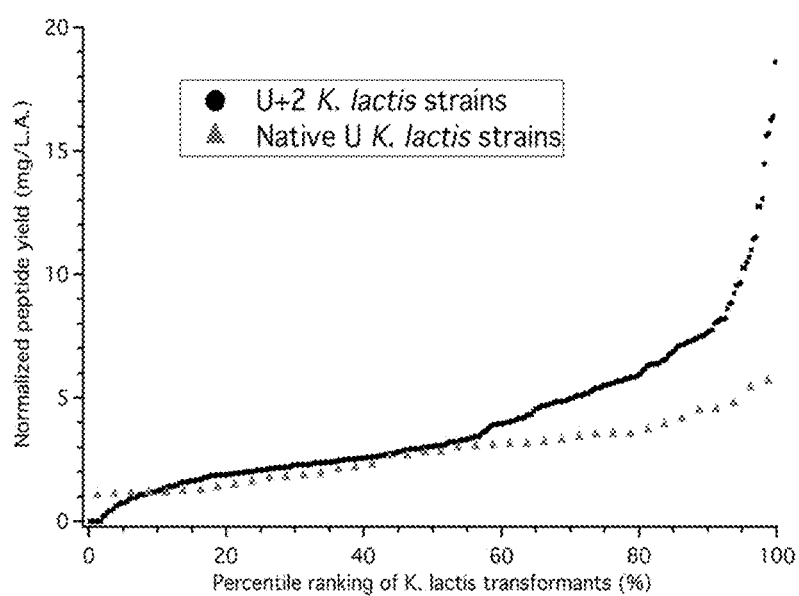
FIG. 13 is another graphical representation of the distribution of the normalized peptide yields from U+2 and native U-ACTX-Hv1a K. lactis strains. Here the y-axis shows the normalized yield (normalized for cell density in the respective cultures as described below) in milligrams per liter per light absorbance unit at wavelength of 600 nm (mg/L.A.) for individual strains, and the x-axis corresponds to the percentile rank of the observed yield for each strain, in relation to the yield observed for all other K. lactis strains engineered to produce the same peptide isoform.

Table 1, FIG. 12 and FIG. 13 summarize the U+2- and native U-ACTX-Hv1a normalized peptide yield distributions from the $K.$ $lactis$ strains. The overall averaged U+2-ACTX-Hv1a normalized peptide yield from the $K.$ $lactis$ strains was 4.06±3.05 mg/L·A, which was statistically significantly higher than the averaged native U-ACTX-Hv1a normalized peptide yield, 2.73±1.25 mg/L·A, by Student's t-test at 99% confidence level. The median normalized peptide yield of the U+2-ACTX-Hv1a $K.$ $lactis$ strains was 9.36 mg/L·A, which was almost three times higher than the median yield of native U-ACTX-Hv1a strains (3.35 mg/L·A). The U+2-ACTX-Hv1a peptide expression strains had much higher ratios of the strain counts at high yield level than the native U-ACTX-Hv1a strains. All of these results indicated that the addition of the glycine-serine dipeptide to the N-terminus of the U-ACTX-Hv1a peptide contributes to significant improvement of the predicted yield for yeast transformants expressing this peptide.

Table 1 shows a comparison of peptide yields from *K. lactis* strains.

TABLE 1

U + 2 and native U-ACTX-Hv1a Peptide Yield Comparison

| | U + 2 Yield (total 316 strains) | | | | Native U Yield (total 40 strains) | | | |
|---|---|---|---|---|---|---|---|---|
| Normalized Yield Level | Strain count | Ratio to total | Overall average | Median Yield | Strain count | Ratio to total | Overall average | Median Yield |
| >2 mg/L · A | 242 | 0.765823 | 4.06 ± 3.05 | 9.36 | 26 | 0.65 | 2.73 ± 1.25 | 3.35 |
| >3 mg/L · A | 161 | 0.509494 | (mg/L · A) | (mg/L · A) | 18 | 0.45 | (mg/L · A) | (mg/L · A) |
| >4 mg/L · A | 124 | 0.392405 | | | 6 | 0.15 | | |
| >6 mg/L · A | 62 | 0.196203 | | | 0 | 0 | | |
| >8 mg/L · A | 29 | 0.0917722 | | | 0 | 0 | | |
| >10 mg/L · A | 16 | 0.0506329 | | | 0 | 0 | | |
| >12 mg/L · A | 9 | 0.028481 | | | 0 | 0 | | |
| >14 mg/L · A | 6 | 0.0189873 | | | 0 | 0 | | |

FIG. 12 shows the histograms of the normalized peptide yield distributions for the U+2 and native U strains. The X scale shows the range of the normalized peptide yield. The Y scale on the left shows the frequency of the U+2 producing strains in the specific range of the normalized yield, and the Y scale on the right shows the frequency of the native U producing strains in the specific range of the normalized yield. The black bars represent the U+2 yield distribution and the grey bars represent the native U yield distribution. For example, the first black bar tells that about 0.03 (3%) of the total U+2 producing strains have normalized yields between 0 and 0.5 mg/L·A. The strain counts are different between native and +2 strains because 316 strains for U+2 were screened and 40 strains for the native peptide were screened.

FIG. 13 shows the distribution of the peptide yields from U+2 and native U-ACTX-Hv1a produced from the *K. lactis* strains. The U+2 data is shown in black and the native U data is in gray. The x-axis shows the yield in milligrams per liter and the y-scale shows the fraction of total U+2 or native U production from *K. lactis* strains. The yield from the U+2 strains, and the number of U+2 strains available that can produce high yields is far higher for the U+2 strains as compared to the native U strains.

Figure 14:
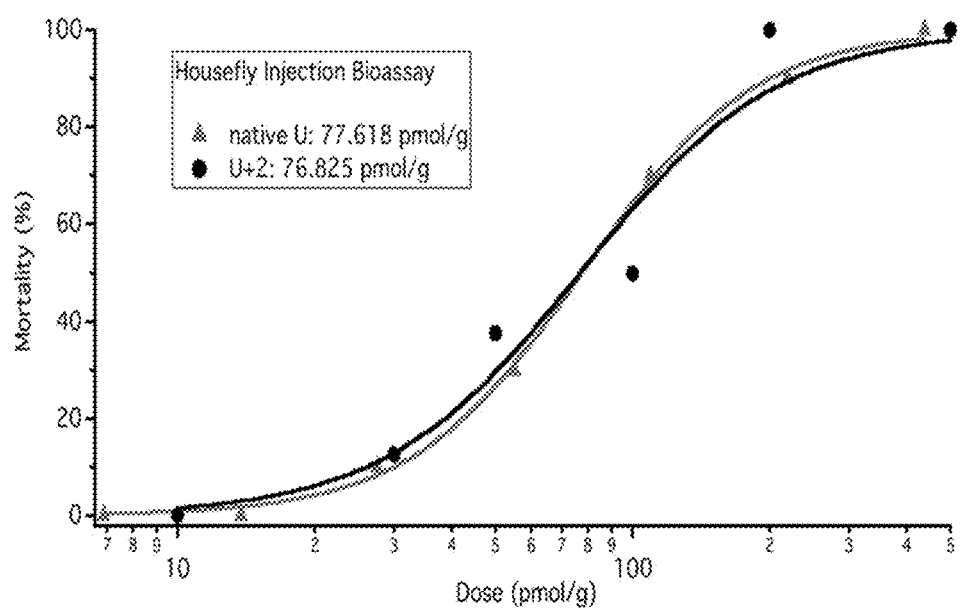
FIG. 14 is a graphical representation of the dose-response of housefly injection bioassay's with U+2 and native U-ACTX-Hv1a. The U+2 data is marked with black round dots and the native U data is marked with gray triangles. The x-scale shows the dose in units of picomoles per gram of housefly. The y-scale shows the mortality percentage.

Ordinarily one might expect making changes to a peptide sequence that dramatically improves its yield could affect its toxicity. Surprisingly that is not what happens with the dipeptides of this disclosure. Our data indicates the addition of the dipeptide, and especially the glycine-serine dipeptide, to the N-terminus of the U-ACTX-Hv1a peptide, does not lower the effectiveness of the insecticidal activities of the peptide. FIG. 14 shows two dose-response curves for housefly injection bioassays performed with the native and U+2-ACTX-Hv1a conditioned medium samples. The U+2-ACTX-Hv1a has a median lethal dose (LD50) of 76.8 pmol/g, which is consistent with the LD50 of native U-ACTX-Hv1a, 77.6 pmol/g.

Example 2

Peptide yields of transformants of the yeast, *Pichia pastoris* (*P. pastoris*), expressing either U+2-ACTX-Hv1a or U-ACTX-Hv1a were studied.

Two *P. pastoris* vectors, pJUGαKR and pJUZαKR, were used for the U+2-ACTX-Hv1a or native U-ACTX-Hv1a peptide expression in *P. pastoris*. pJUGαKR and pJUZαKR are available from Biogrammatics, Carlsbad, California, USA. Both vectors are integrative vectors and use the uracil phosphoribosyltransferase promoter (pUPP) to enhance the heterologous transgene expression. The only difference between the vectors is that pJUGαKR provides G418 resistance to the host yeast, while pJUZαKR provides Zeocin resistance.

Pairs of complementary oligonucleotides, encoding the native U-ACTX-Hv1a and U+2-ACTX-Hv1a respectively, were designed and synthesized for sub cloning into the two yeast expression vectors. Hybridization reactions were performed by mixing the corresponding complementary oligonucleotides to a final concentration of 20 μM in 30 mM NaCl, 10 mM Tris-Cl (all final concentrations), pH 8, and then incubating at 95° C. for 20 min, followed by a 9 hour incubation starting at 92° C. and ending at 17° C., with 3° C. drops in temperature every 20 min. The hybridization reactions resulted in two DNA fragments encoding U+2-ACTX-Hv1a and native U-ACTX-Hv1a peptides respectively. The two *P. pastoris* vectors were digested with BsaI-HF restriction enzymes, and the double stranded products of the Uization reactions were then sub cloned into the linearized *P. pastoris* vectors using standard procedures. Following verification of the sequences of the four sub clones, plasmid aliquots were transformed by electroporation into the *P. pastoris* strain, Bg08. The resulting transformed yeast, selected based on resistance to Zeocin or G418 conferred by elements engineered into vectors pJUZαKR and pJUGαKR, respectively, were cultured and screened as described below. Since no transformant strains had more than one antibiotic resistance marker, and since transformation procedures were performed the same for yeast cells transformed with the U+2-ACTX-Hv1a transgene as for those transformed with the native U-ACTX-Hv1a transgene, it is reasonable to presume that the distributions of transgene copy number were comparable for the two populations of transformants being compared below.

Recipes for media and stocks used for the *P. pastoris* cultures are described as follows:

MSM media recipe
2 g/L sodium citrate dihydrate
1 g/L calcium sulfate dihydrate (0.79 g/L anhydrous calcium sulfate)
42.9 g/L potassium phosphate monobasic
5.17 g/L ammonium sulfate
14.33 g/L potassium sulfate
11.7 g/L magnesium sulfate heptahydrate
2 mL/L PTM1trace salt solution
0.4 ppm biotin (from 500×, 200 ppm stock)
1-2% pure glycerol or other carbon source PTM1 Trace Salts Solution:
  Cupric sulfate-5H$_2$O 6.0 g
  Sodium iodide 0.08 g
  Manganese sulfate-H$_2$O 3.0 g
  Sodium molybdate-2H$_2$O 0.2 g
  Boric Acid 0.02 g
  Cobalt chloride 0.5 g
  Zinc chloride 20.0 g
  Ferrous sulfate-7H$_2$O 65.0 g
  Biotin 0.2 g
  Sulfuric Acid 5.0 ml
  Add Water to a final volume of 1 liter 48-well Deep-well plates, sealed after inoculation with sterile, air-permeable tape, were used to culture the insecticidal peptide *P. pastoris* transformants. Colonies on the *P. pastoris* transformant plates were picked and inoculated the deep-well plates with 1 mL media per well, which was composed of MSM+0.2% PTM1+biotin (500× diluted from 200 ppm stock)+1% glycerol (pure). Inoculated plates were grown 5 days at 23.5° C. with 220 rpm shaking in a refrigerated incubator-shaker. 100 µL 5% glycerol were added to each well of the plates at 2, 3, and 4 days post inoculation. On day 5 post-inoculation, conditioned media was harvested by centrifugation at 3700 rpm for 15 minutes, followed by filtration using filter plate with 0.22 µM membrane. Filtered media stored at −20° C. for further analyses.

Figure 15:
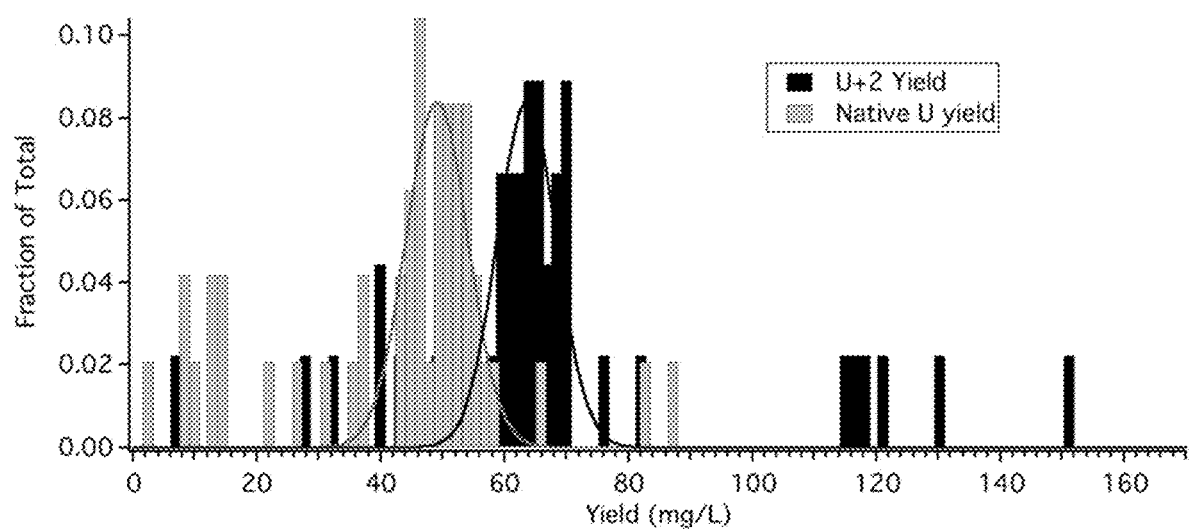
FIG. 15 is a graphical representation of the distribution of the peptide yields from U+2 and native U-ACTX-Hv1a produced from Pichia pastoris (P. pastoris) strains. The U+2 data is shown in black and the native U data is in gray. The x-axis shows the yield in milligrams per liter and the y-scale shows the fraction of total U+2 or native U production from P. pastoris strains.
Figure 16:
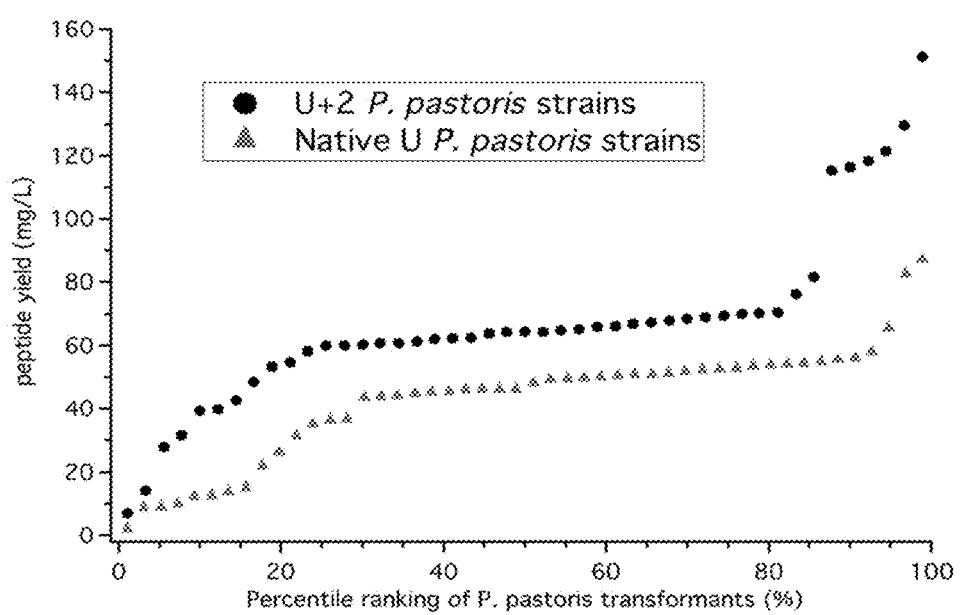
FIG. 16 is another graphical representation of the distribution of the peptide yields of U+2 and native U-ACTX-Hv1a produced from P. pastoris strains. Here the y-axis shows the yield in milligrams per liter for individual strains, and the x-axis corresponds to the percentile rank of the observed yield for each strain (in relation to the yields observed for all other P. pastoris strains engineered to produce the same peptide isoform).

0.3 mL aliquots of conditioned *P. pastoris* media prepared as described above were analyzed using rpHPLC described in EXAMPLE 1 to determine the concentrations of the native U-ACTX-Hv1a or U+2-ACTX-Hv1a peptide present in the media. Results of this analysis are summarized in Table 2, FIG. 15 and FIG. 16. The average peptide yields with a common mean and standard deviation are 67.0±27.9 mg/L for the U+2-ACTX-Hv1a *P. pastoris* strains and 42.9±18.3 mg/L for the native U-ACTX-Hv1a strains. A student's t-test indicated that the probability of such differing distributions of yields is far below 1%. The median yield from the U+2-ACTX-Hv1a strains was 79.0 mg/L, far higher than that from the native U-ACTX-Hv1a strains (44.7 mg/L). It is observed that the U+2-ACTX-Hv1a strains had much higher ratios of the strain counts at high peptide yield level than the native U-ACTX-Hv1a strains. All these results support the conclusion that the extra glycine-serine dipeptide at the N-terminus of the U+2-ACTX-Hv1a significantly improved the capacity of yeast transformants to produce this peptide and secrete it into conditioned media.

Table 2 shows a comparison of peptide yields from *P. pastoris* strains.

Example 3

Expression of one of the type 3 sea anemone toxins discovered from *Anemone viridis*, native Av3 and Av3+2 in the yeast strain *Kluyveromyces lactis*.

Insecticidal Peptides to Express:

```
Av3 + 2:
                                    (SEQ ID NO. 29)
GSRSCCPCYWGGCPWGQNCYPEGCSGPKV

Native Av3:
                                    (SEQ ID NO. 30)
RSCCPCYWGGCPWGQNCYPEGCSGPKV
```

To express the two non-ICK CRIP peptides above in *Kluyveromyces lactis*, the pKLAC1 vector and the *Kluyveromyces lactis* strain, YCT306, were used as in example 1.

The Av3 and Av3+2 peptide ORF, which encode α-MF::Kex2 cleavage site::Av3 (or Av3+2), were codon-optimized using previously determined *K. lactis* expression algorithm.

The optimized Av3+2 expression ORF sequence is follows:

```
                                    (SEQ ID NO. 31)
AAGCTTGAAAAAAATGAAATTTTCCACTATTTTAGCAGCATCTACAGCTT

TAATCAGTGTTGTCATGGCTGCACCTGTGAGTACCGAAACAGATATAGAC

GACCTTCCAATCTCTGTTCCAGAAGAGGCTTTGATAGGATTCATCGATTT

GACTGGTGATGAAGTTTCATTGTTACCAGTGAATAATGGTACCCATACTG

GTATTTTGTTCCTAAACACCACAATTGCTGAAGCTGCTTTTGCAGATAAG

GATGATTTGGAGAAAAGAGGTTCTAGATCATGCTGCCCTTGTTACTGGGG

TGGTTGTCCATGGGGACAAAACTGTTATCCTGAAGGATGTTCTGGTCCAA

AGGTATGAGCGGCCGC
```

This optimized DNA sequence was cloned into pKLAC1 vector using Hind III and Not I restriction sites, resulting in the Av3+2 expression vector, pLB102.

TABLE 2

U + 2 and native U-ACTX-Hv1a Peptide Yield Comparison

| | U + 2 Yield (total 45 strains) | | | | Native U Yield (total 48 strains) | | | |
|---|---|---|---|---|---|---|---|---|
| Normalized Yield Level | Strain count | Ratio to total | Overall average | Median Yield | Strain count | Ratio to total | Overall average | Median Yield |
| >30 mg/L | 42 | 93.3% | 67.0 ± 27.9 (mg/L) | 79.0 (mg/L) | 38 | 79.2% | 42.9 ± 18.3 (mg/L) | 44.7 (mg/L) |
| >40 mg/L | 39 | 86.7% | | | 34 | 70.8% | | |
| >50 mg/L | 37 | 82.2% | | | 19 | 39.6% | | |
| >60 mg/L | 34 | 75.6% | | | 3 | 6.3% | | |
| >70 mg/L | 11 | 24.4% | | | 2 | 4.2% | | |
| >80 mg/L | 7 | 15.6% | | | 2 | 4.2% | | |
| >90 mg/L | 6 | 13.3% | | | 0 | 0 | | |
| >100 mg/L | 6 | 13.3% | | | 0 | 0 | | |

The optimized native Av3 expression ORF sequence is follows:

(SEQ ID NO. 32)
```
AAGCTTGAAAAAAATGAAATTTTCCACAATCTTAGCTGCAAGTACTGCTC

TTATTTCTGTTGTGATGGCTGCTCCAGTATCTACCGAAACAGATATCGAT

GATTTGCCAATTTCAGTCCCTGAAGAGGCACTAATCGGATTCATTGACTT

AACCGGTGATGAAGTGAGTTTGTTGCCAGTTAACAACGGTACTCATACAG

GTATATTGTTTTTGAATACCACTATAGCTGAAGCAGCATTCGCTGATAAA

GATGACTTAGAAAAGAGAAGATCATGCTGCCCTTGTTACTGGGGTGGTTG

TCCATGGGGTCAAAATTGTTATCCAGAGGGTTGTTCTGGACCTAAGGTTT

GAGCGGCCGC
```

This optimized DNA sequence was cloned into pKLAC1 vector using Hind III and Not I restriction sites, resulting in the native Av3 expression vector, pLB103.

The expression vectors, pLB102 and pLB103, were then linearized using Sac II restriction endonuclease and transformed into YCT306 strain of *K. lactis*, using the electroporation transformation method. The resulting transformants grew on YCB agar plate supplemented with 5 mM acetamide, which only the acetamidase-expressing transformants could use efficiently as a metabolic source of nitrogen.

For insecticidal peptide yield evaluations, 48 colonies of pLB102 transformants and 48 colonies of pLB103 transformants were picked up and inoculated 2.2 mL of the defined *K. lactis* media with 2% sorbitol added as a carbon source in 48-well deep-well plates with 5 mL volume capacity each well. Cultures were processed at 23.5° C., with shaking at 280 rpm, for six days, when cell densities in the cultures were determined by light absorbance at 600 nm (OD600). Cells were then removed from the cultures by centrifugation at 4000 rpm for 10 minutes. The resulting supernatants (conditioned media) were filtered through 0.2 m membranes for HPLC yield analysis.

For the peptide yield evaluation, the filtered conditioned media samples were analyzed on an Agilent 1100 HPLC system equipped with an Onyx monolithic 4.5×100 mm, C18 reverse-phase analytical HPLC column and an autoinjector. HPLC grade water and acetonitrile, both containing 0.1% trifluoroacetic acid, constituted the two mobile phase solvents used for the HPLC analyses. The native Av3 or Av3+2 peak areas in the resulting HPLC chromatographs were used as indication of the peptide concentration in the conditioned media, which were then further normalized to the corresponding final cell densities (as determined by OD600 measurements) as normalized peptide yield.

Figure 17:
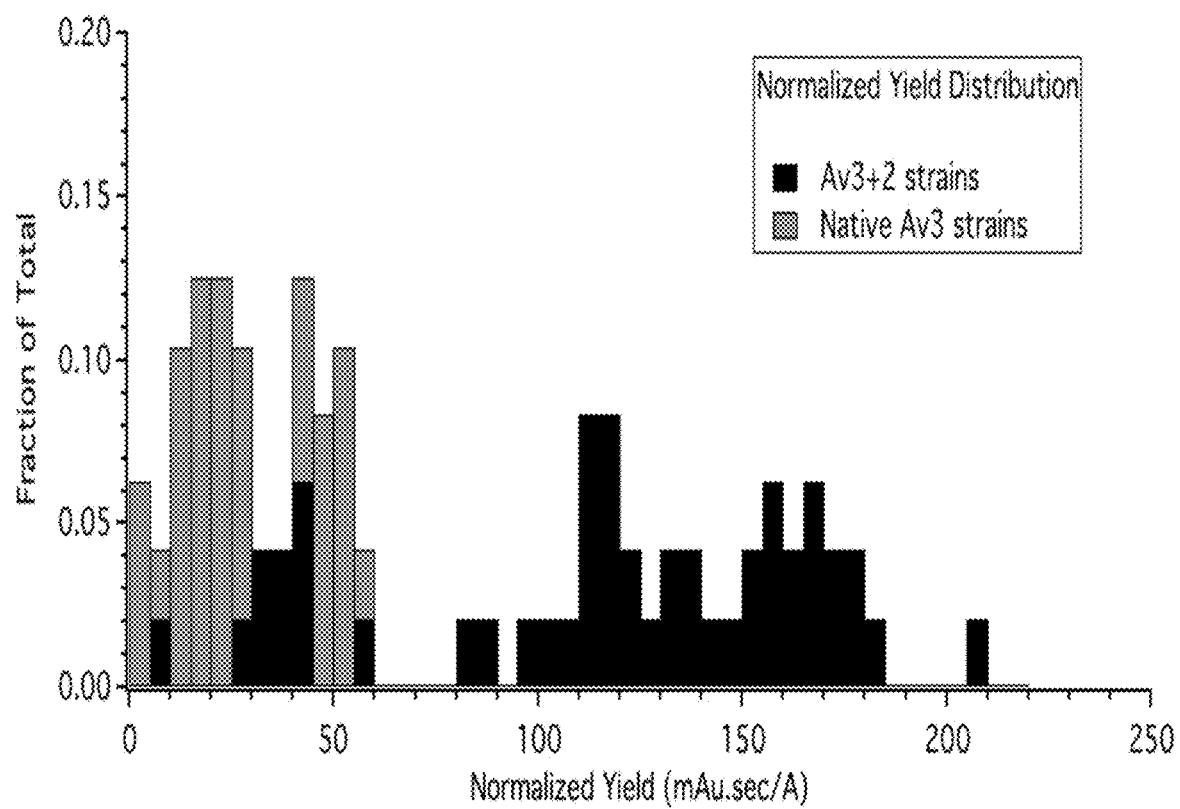
FIG. 17 is a graphical representation of the distribution of the peptide yields of sea anemone toxin, Av3 and Av3+2, produced from the K. lactis expression strains. The native toxin is named Av3 from the sea anemone named Anemonia viridis. The modified toxin here is labeled Av3+2. Like the example above we produced the toxic peptides in strains of Kluyveromyces lactis or K. lactis. The x-axis shows the peptide yield in mAu·sec/A for individual strains, and the y-axis shows the fraction of the strains.
Figure 18:
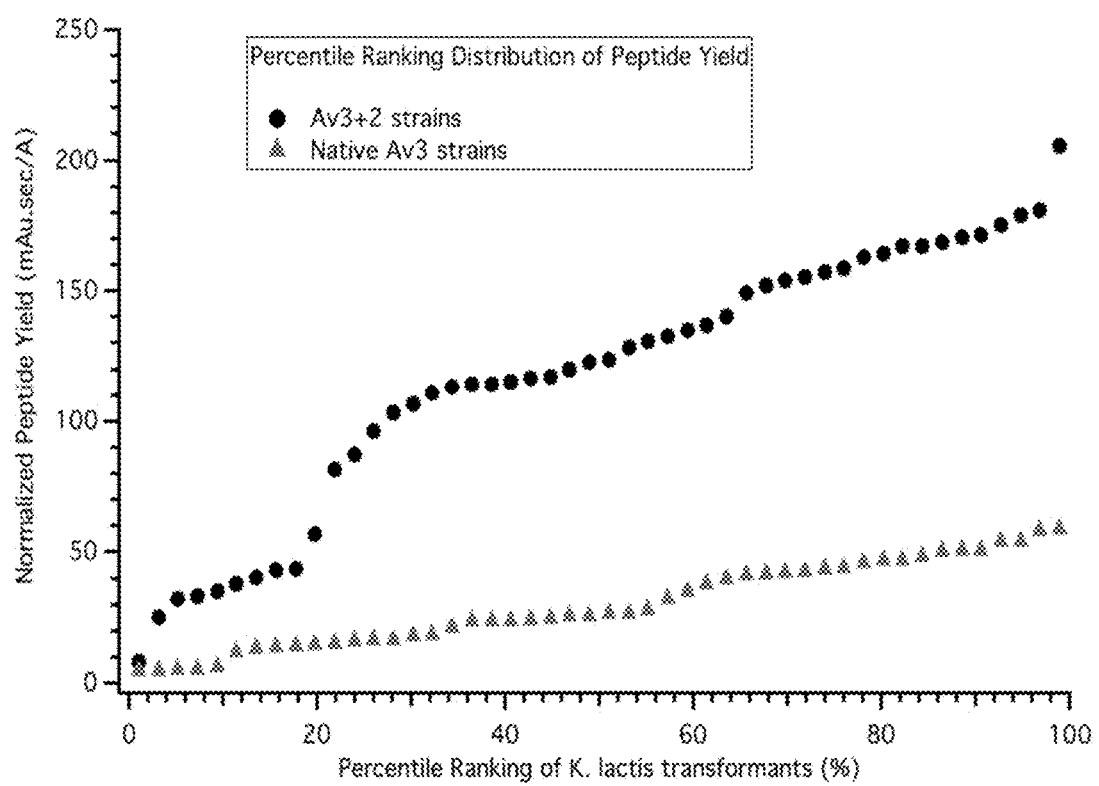
FIG. 18 shows the difference in the peptide yields of Av3+2 and native Av3 produced from the corresponding K. lactis strains by plotting the peptide yields as a function of the percentile rank of the transformants which produce the same peptide. Here the y-axis shows the normalized yield in mAu·sec/A for individual strains, and the x-axis corresponds to the percentile rank of the observed yield for each strain, in relation to the yield observed for all other K. lactis strains engineered to produce the same peptide isoform.

Table 3, FIG. 17 and FIG. 18 summarize the Av3+2 and native Av3 normalized peptide yield distributions from the *K. lactis* strains. The normalized peptide yield is represented by the peptide UV peak area in the HPLC chromatograph divided by the corresponding cell density (represented by the OD600) at the end of the cell culture. The overall averaged normalized peptide yield from the Av3+2 strains was 117.5±50.1 mAu·sec/A, which was statistically significantly higher than that of native Av3 which was 29.8±16.1 mAu·sec/A, by Student's t-test at 99% confidence level. The median normalized peptide yield of the Av3+2 *K. lactis* strains was 106.7 mAu·sec/A, which was more than three times higher than that of native Av3 strains (31.7 mAu·sec/A). The Av3+2 expression strains had much higher ratios of the strain counts at high yield level than the native Av3 strains (table 3). And as shown in FIG. 18, overall at the any percentile of peptide yield, Av3+2 strains had higher yield than native Av3 strains. All of these results indicated that the addition of the glycine-serine dipeptide to the N-terminus of the Av3 peptide contributes to significant improvement of the peptide yield from yeast transformants expressing this peptide.

TABLE 3

Av3 + 2 and native Av3 Peptide Yield Comparison

| | Av3 + 2 Yield (pLB102-YCT, total 48 strains) | | | | Av3 (pLB103-YCT, total 48 strains) | | | |
|---|---|---|---|---|---|---|---|---|
| Normalized Yield Level | Strain count | Ratio to total | Overall average | Median Yield | Strain count | Ratio to total | Overall average | Median Yield |
| >30 mAu · sec/A | 46 | 0.958 | 117.5 ± 50.1 (mAu · sec/A) | 106.7 (mAu · sec/A) | 21 | 0.438 | 29.8 ± 16.1 (mAu · sec/A) | 31.7 (mAu · sec/A) |
| >60 mAu · sec/A | 38 | 0.792 | | | 0 | 0 | | |
| >90 mAu · sec/A | 36 | 0.75 | | | 0 | 0 | | |
| >120 mAu · sec/A | 25 | 0.521 | | | 0 | 0 | | |
| >150 mAu · sec/A | 16 | 0.333 | | | 0 | 0 | | |
| >180 mAu · sec/A | 2 | 0.042 | | | 0 | 0 | | |
| >2000 mAu · sec/A | 1 | 0.021 | | | 0 | 0 | | |

Crops and Insects

Specific crops and insects that may be controlled by these methods include the following:

The present invention may be used for transformation of any plant species, including, but not limited to, monocots and dicots. Crops for which a transgenic approach or PEP would be an especially useful approach include, but are not limited to: alfalfa, cotton, tomato, maize, wheat, corn, sweet corn, luceme, soybean, sorghum, field pea, linseed, safflower, rapeseed, oil seed rape, rice, soybean, barley, sunflower, trees (including coniferous and deciduous), flowers (including those grown commercially and in greenhouses), field lupins, switchgrass, sugarcane, potatoes, tomatoes, tobacco, crucifers, peppers, sugarbeet, barley, and oilseed rape, *Brassica* sp., rye, millet, peanuts, sweet potato, cassaya, coffee, coconut, pineapple, citrus trees, cocoa, tea, banana, avocado, fig, guava, mango, olive, papaya, cashew, macadamia, almond, oats, vegetables, ornamentals, and conifers.

"Pest" includes, but is not limited to: insects, fungi, bacteria, nematodes, mites, ticks, and the like.

Insect pests include, but are not limited to, insects selected from the orders Coleoptera, Diptera, Hymenoptera, Lepidoptera, Mallophaga, Homoptera, Hemiptera, Orthroptera, Thysanoptera, Dermaptera, Isoptera, Anoplura, Siphonaptera, Trichoptera, and the like. More particularly, insect pests include Coleoptera, Lepidoptera, and Diptera.

Insects of suitable agricultural, household and/or medical/veterinary importance for treatment with the insecticidal polypeptides include, but are not limited to, members of the following classes and orders:

The order Coleoptera includes the suborders Adephaga and Polyphaga. Suborder Adephaga includes the superfamilies Caraboidea and Gyrinoidea. Suborder Polyphaga includes the superfamilies Hydrophiloidea, Staphylinoidea, Cantharoidea, Cleroidea, Elateroidea, Dascilloidea, Dryopoidea, Byrrhoidea, Cucujoidea, Meloidea, Mordelloidea, Tenebrionoidea, Bostrichoidea, Scarabaeoidea, Cerambycoidea, Chrysomeloidea, and Curculionoidea. Superfamily Caraboidea includes the families Cicindelidae, Carabidae, and Dytiscidae. Superfamily Gyrinoidea includes the family Gyrinidae. Superfamily Hydrophiloidea includes the family Hydrophilidae. Superfamily Staphylinoidea includes the families Silphidae and Staphylinidae. Superfamily Cantharoidea includes the families Cantharidae and Lampyridae. Superfamily Cleroidea includes the families Cleridae and Dermestidae. Superfamily Elateroidea includes the families Elateridae and Buprestidae. Superfamily Cucujoidea includes the family Coccinellidae. Superfamily Meloidea includes the family Meloidae. Superfamily Tenebrionoidea includes the family Tenebrionidae. Superfamily Scarabaeoidea includes the families Passalidae and Scarabaeidae. Superfamily Cerambycoidea includes the family Cerambycidae. Superfamily Chrysomeloidea includes the family Chrysomelidae. Superfamily Curculionoidea includes the families Curculionidae and Scolytidae.

Examples of Coleoptera include, but are not limited to: the American bean weevil *Acanthoscelides obtectus*, the leaf beetle *Agelastica alni*, click beetles (*Agriotes lineatus, Agriotes obscurus, Agriotes bicolor*), the grain beetle *Ahasverus advena*, the summer schafer *Amphimallon solstitialis*, the furniture beetle *Anobium punctatum, Anthonomus* spp. (weevils), the Pygmy mangold beetle *Atomaria linearis*, carpet beetles (*Anthrenus* spp., *Attagenus* spp.), the cowpea weevil *Callosobruchus maculates*, the fried fruit beetle *Carpophilus hemipterus*, the cabbage seedpod weevil *Ceutorhynchus assimilis*, the rape winter stem weevil *Ceutorhynchus picitarsis*, the wireworms *Conoderus vespertinus* and *Conoderus falli*, the banana weevil *Cosmopolites sordidus*, the New Zealand grass grub *Costelytra zealandica*, the June beetle *Cotinis nitida*, the sunflower stem weevil *Cylindrocopturus adspersus*, the larder beetle *Dermestes lardarius*, the corn rootworms *Diabrotica virgifera, Diabrotica virgifera virgifera*, and *Diabrotica barberi*, the Mexican bean beetle *Epilachna varivestis*, the old house borer *Hylotropes bajulus*, the luceme weevil *Hypera postica*, the shiny spider beetle *Gibbium psylloides*, the cigarette beetle *Lasioderma serricorne*, the Colorado potato beetle *Leptinotarsa decemlineata*, Lyctus beetles' (*Lyctus* spp.), the pollen beetle *Meligethes aeneus*, the common cockshafer *Melolontha melolontha*, the American spider beetle *Mezium americanum*, the golden spider beetle *Niptus hololeucus*, the grain beetles *Oryzaephilus surinamensis* and *Oryzaephilus mercator*, the black vine weevil *Otiorhynchus sulcatus*, the mustard beetle *Phaedon cochleariae*, the crucifer flea beetle *Phyllotreta cruciferae*, the striped flea beetle *Phyllotreta striolata*, the cabbage steam flea beetle *Psylliodes chrysocephala, Ptinus* spp. (spider beetles), the lesser grain borer *Rhizopertha dominica*, the pea and been weevil *Sitona lineatus*, the rice and granary beetles *Sitophilus oryzae* and *Sitophilus* granaries, the red sunflower seed weevil *Smicronyx fulvus*, the drugstore beetle *Stegobium paniceum*, the yellow mealworm beetle *Tenebrio molitor*, the flour beetles *Tribolium castaneum* and *Tribolium confusum*, warehouse and cabinet beetles (*Trogoderma* spp.), and the sunflower beetle *Zygogramma exclamation*'s.

Examples of Dermaptera (earwigs) include, but are not limited to: the European earwig *Forficula auricularia*, and the striped earwig *Labidura riparia*.

Examples of Dictvontera include, but are not limited to: the oriental cockroach *Blatta orientalis*, the German cockroach *Blatella germanica*, the Madeira cockroach *Leucophaea maderae*, the American cockroach *Periplaneta americana*, and the smokybrown cockroach *Periplaneta fuliginosa*.

Examples of Diplonoda include, but are not limited to: the spotted snake millipede *Blaniulus guttulatus*, the flat-back millipede *Brachydesmus superus*, and the greenhouse millipede *Oxidus gracilis*.

The order Diptera includes the Suborders Nematocera, Brachycera, and Cyclorrhapha. Suborder Nematocera includes the families Tipulidae, Psychodidae, Culicidae, Ceratopogonidae, Chironomidae, Simuliidae, Bibionidae, and Cecidomyiidae. Suborder Brachycera includes the families Stratiomyidae, Tabanidae, Therevidae, Asilidae, Mydidae, Bombyliidae, and Dolichopodidae. Suborder Cyclorrhapha includes the Divisions Aschiza and Aschiza. Division Aschiza includes the families Phoridae, Syrphidae, and Conopidae. Division Aschiza includes the Sections Acalyptratae and Calyptratae. Section Acalyptratae includes the families Otitidae, Tephritidae, Agromyzidae, and Drosophilidae. Section Calyptratae includes the families Hippoboscidae, Oestridae, Tachinidae, Anthomyiidae, Muscidae, Calliphoridae, and Sarcophagidae.

Examples of Diptera include, but are not limited to: the house fly (*Musca domestica*), the African tumbu fly (*Cordylobia anthropophaga*), biting midges (*Culicoides* spp.), bee louse (*Braula* spp.), the beet fly *Pegomyia betae*, blackflies (*Cnephia* spp., *Eusimulium* spp., *Simulium* spp.), bot flies (*Cuterebra* spp., *Gastrophilus* spp., *Oestrus* spp.), craneflies (*Tipula* spp.), eye gnats (*Hippelates* spp.), filth-breeding flies (*Calliphora* spp., *Fannia* spp., *Hermetia* spp., *Lucilia* spp., *Musca* spp., *Muscina* spp., *Phaenicia* spp., Phormia spp.), flesh flies (*Sarcophaga* spp., *Wohlfahrtia* spp.); the flit fly *Oscinella frit*, fruitflies (Dacus spp., *Drosophila* spp.), head and canon flies (*Hydrotea* spp.), the hessian fly *Mayetiola destructor*, hom and buffalo flies (*Haematobia* spp.), horse and deer flies (*Chrysops* spp., *Haematopota* spp., *Tabanus* spp.), louse flies (*Lipoptena* spp., *Lynchia* spp., and *Pseudolynchia* spp.), medflies (*Ceratitus* spp.), mosquitoes (*Aedes* spp., *Anopheles* spp., *Culex* spp., *Psorophora* spp.), sandflies (*Phlebotomus* spp., *Lutzomyia* spp.), screw-worm flies (*Chtysomya bezziana* and *Cochliomyia hominivorax*), sheep keds (*Melophagus* spp.); stable flies (*Stomoxys* spp.), tsetse flies (*Glossina* spp.), and warble flies (*Hypoderma* spp.).

Examples of Isontera (termites) include, but are not limited to: species from the familes Hodotennitidae, Kalotermitidae, Mastotermitidae, Rhinotennitidae, Serritermitidae, Termitidae, Termopsidae;

Examples of Heteroptera include, but are not limited to: the bed bug *Cimex lectularius*, the cotton stainer *Dysdercus intermedius*, the Sunn pest *Eurygaster integriceps*, the tarnished plant bug *Lygus lineolaris*, the green stink bug *Nezara antennata*, the southern green stink bug *Nezara viridula*, and the triatomid bugs *Panstrogylus megistus, Rhodnius ecuadoriensis, Rhodnius pallescans, Rhodnius prolixus, Rhodnius robustus, Triatoma dimidiata, Triatoma infestans*, and *Triatoma sordida*.

Examples of Homoptera include, but are not limited to: the California red scale Aonidiella *aurantii*, the black bean aphid *Aphis fabae*, the cotton or melon aphid *Aphis gossypii*, the green apple aphid *Aphis pomi*, the citrus spiny whitefly *Aleurocanthus spinferus*, the oleander scale *Aspidiotus hederae*, the sweet potato whitefly *Bemesia tabaci*, the cabbage aphid *Brevicoryne brassicae*, the pear psylla *Cacopsylla pyricola*, the currant aphid *Cryptomyzus ribis*, the grape phylloxera *Daktulosphaira vitifoliae*, the citrus psylla *Diaphorina citri*, the potato leafhopper *Empoasca fabae*, the bean leafhopper *Empoasca solana*, the vine leafhopper *Empoasca vitis*, the woolly aphid *Eriosoma lanigerum*, the European fruit scale *Eulecanium corni*, the mealy plum aphid *Hyalopterus arundinis*, the small brown planthopper *Laodelphax striatellus*, the potato aphid *Macrosiphum euphorbiae*, the green peach aphid *Myzus persicae*, the green rice leafhopper *Nephotettix cinticeps*, the brown planthopper *Nilaparvata lugens*, gall-forming aphids (*Pemphigus* spp.), the hop aphid *Phorodon humuli*, the bird-cherry aphid *Rhopalosiphum padi*, the black scale *Saissetia oleae*, the greenbug *Schizaphis graminum*, the grain aphid *Sitobion avenae*, and the greenhouse whitefly *Trialeurodes vaporariorum*.

Examples of Isopoda include, but are not limited to: the common pillbug *Armadillidium vulgare* and the common woodlouse *Oniscus asellus*.

The order Lepidoptera includes the families Papilionidae, Pieridae, Lycaenidae, Nymphalidae, Danaidae, Satyridae, Hesperiidae, Sphingidae, Saturmiidae, Geometridae, Arctiidae, Noctuidae, Lymantriidae, Sesiidae, and Tineidae.

Examples of Lepidoptera include, but are not limited to: *Adoxophyes orana* (summer fruit tortrix moth), *Agrotis ipsolon* (black cutworm), *Archips podana* (fruit tree *tortrix* moth), *Bucculatrix pyrivorella* (pear leafiiner), *Bucculatrix thurberiella* (cotton leaf perforator), *Bupalus piniarius* (pine looper), *Carpocapsa pomonella* (codling moth), *Chilo suppressalis* (striped rice borer), *Choristoneura fumiferana* (eastern spruce budworm), *Cochylis hospes* (banded sunflower moth), *Diatraea grandiosella* (southwestern corn borer), *Earls insulana* (Egyptian bollworm), *Euphestia kuehniella* (Mediterranean flour moth), *Eupoecilia ambiguella* (European grape berry moth), *Euproctis chrysorrhoea* (brown-tail moth), *Euproctis subflava* (oriental tussock moth), *Galleria mellonella* (greater wax moth), *Helicoverpa armigera* (cotton bollworm), *Helicoverpa zea* (cotton bollworm), *Heliothis virescens* (tobacco budworm), *Hofmannophila pseudopretella* (brown house moth), *Homeosoma electellum* (sunflower moth), *Homona magnanima* (oriental tea tree tortrix moth), *Lithocolletis blancardella* (spotted tentiform leafminer), *Lymantria dispar* (gypsy moth), *Malacosoma neustria* (tent caterpillar), *Mamestra brassicae* (cabbage armyworm), *Mamestra configurata* (Bertha armyworm), the homworms *Manduca sexta* and *Manuduca quinquemaculata*, *Operophtera brumata* (winter moth), *Ostrinia nubilalis* (European corn borer), *Panolis flammea* (pine beauty moth), *Pectinophora gossypiella* (pink bollworm), *Phyllocnistis citrella* (citrus leafminer), *Pieris brassicae* (cabbage white butterfly), *Plutella xylostella* (diamondback moth), *Rachiplusia ni* (soybean looper), *Spilosoma virginica* (yellow bear moth), *Spodoptera exigua* (beet armyworm), *Spodoptera frugiperda* (fall armyworm), *Spodoptera littoralis* (cotton leafworin), *Spodoptera litura* (common cutworm), *Spodoptera praefica* (yellowstriped armyworm), *Sylepta derogata* (cotton leaf roller), *Tineola bisselliella* (webbing clothes moth), *Tineola pellionella* (case-making clothes moth), *Tortrix viridana* (European oak leafroller), *Trichoplusia ni* (cabbage looper), and *Yponomeuta padella* (small ermine moth).

Examples of Orthoptera include, but are not limited to: the common cricket *Acheta domesticus*, tree locusts (*Anacridium* spp.), the migratory locust *Locusta migratoria*, the twostriped grasshopper *Melanoplus bivittatus*, the differential grasshopper *Melanoplus dfferentialis*, the redlegged grasshopper *Melanoplus femurrubrum*, the migratory grasshopper *Melanoplus sanguinipes*, the northern mole cricket *Neocurtilla hexadectyla*, the red locust *Nomadacris septemfasciata*, the shortwinged mole cricket *Scapteriscus abbreviatus*, the southern mole cricket *Scapteriscus borellii*, the tawny mole cricket *Scapteriscus vicinus*, and the desert locust *Schistocerca gregaria*.

Examples of Phthiraptera include, but are not limited to: the cattle biting louse *Bovicola bovis*, biting lice (*Damalinia* spp.), the cat louse *Felicola subrostrata*, the shortnosed cattle louse *Haematopinus eloysternus*, the tail-switch louse *Haematopinus quadriperiussus*, the hog louse *Haematopinus suis*, the face louse *Linognathus ovillus*, the foot louse *Linognathus pedalis*, the dog sucking louse *Linognathus setosus*, the long-nosed cattle louse *Linognathus vituli*, the chicken body louse *Menacanthus stramineus*, the poultry shaft louse *Menopon gallinae*, the human body louse *Pediculus humanus*, the pubic louse *Phthirus pubis*, the little blue cattle louse *Solenopotes capillatus*, and the dog biting louse *Trichodectes canis*.

Examples of Psocoptera include, but are not limited to: the booklice *Liposcelis bostrychophila, Liposcelis decolor, Liposcelis entomophila*, and *Trogium pulsatorium*.

Examples of Siphonaptera include, but are not limited to: the bird flea *Ceratophyllus gallinae*, the dog flea *Ctenocephalides canis*, the cat flea *Ctenocephalides fells*, the human flea *Pulex irritans*, and the oriental rat flea *Xenopsylla cheopis*.

Examples of Symphyla include, but are not limited to: the garden symphylan *Scutigerella immaculate*.

Examples of Thysanura include, but are not limited to: the gray silverfish *Ctenolepisma longicaudata*, the four-lined silverfish *Ctenolepisma quadriseriata*, the common silverfish *Lepisma saccharina*, and the firebrat *Thennobia domestica*;

Examples of Thysanoptera include, but are not limited to: the tobacco *thrips Frankliniella fusca*, the flower *thrips Frankliniella intonsa*, the western flower thrips *Frankliniella occidentalis*, the cotton bud *thrips Frankliniella schultzei*, the banded greenhouse thrips *Hercinothrips femoralis*, the soybean thrips *Neohydatothrips variabilis*, Kelly's citrus thrips *Pezothrips kellyanus*, the avocado thrips *Scirtothrips perseae*, the melon thrips *Thrips palmi*, and the onion thrips *Thrips tabaci*.

Examples of Nematodes include, but are not limited to: parasitic nematodes such as root-knot, cyst, and lesion nematodes, including *Heterodera* spp., *Meloidogyne* spp., and *Globodera* spp.; particularly members of the cyst nematodes, including, but not limited to: *Heterodera glycines* (soybean cyst nematode); *Heterodera schachtii* (beet cyst nematode); *Heterodera avenae* (cereal cyst nematode); and *Globodera rostochiensis* and *Globodera pailida* (potato cyst nematodes). Lesion nematodes include, but are not limited to: *Pratylenchus* spp.

In one embodiment, the insecticidal compositions comprising the polypeptides, polynucleotides, cells, vectors, etc., can be employed to treat ectoparasites. Ectoparasites include, but are not limited to: fleas, ticks, mange, mites, mosquitoes, nuisance and biting flies, lice, and combinations comprising one or more of the foregoing ectoparasites. The term "fleas" includes the usual or accidental species of parasitic flea of the order Siphonaptera, and in particular the species *Ctenocephalides*, in particular *C. felis* and *C. canis*, rat fleas (*Xenopsylla cheopis*) and human fleas (*Pulex irritans*).

Insect pests of the invention for the major crops include, but are not limited to: Maize: *Ostrinia nubilalis*, European corn borer; *Agrotis ipsilon*, black cutworm; *Helicoverpa zea*, corn earworm; *Spodoptera frugiperda*, fall armyworm; *Diatraea grandiosella*, southwestern corn borer; *Elasmopalpus lignosellus*, lesser cornstalk borer; *Diatraea saccharalis*, surgarcane borer; *Diabrotica virgifera*, western corn rootworm; *Diabrotica longicornis barberi*, northern corn rootworm; *Diabrotica undecimpunctata howardi*, southern corn rootworm; Melanotus spp., wireworms; *Cyclocephala borealis*, northern masked chafer (white grub); *Cyclocephala immaculata*, southern masked chafer (white grub); *Popillia japonica*, Japanese beetle; *Chaetocnema pulicaria*, corn flea beetle; *Sphenophorus maidis*, maize billbug; *Rhopalosiphum maidis*, corn leaf aphid; *Anuraphis maidiradicis*, corn root aphid; *Blissus leucopterus leucopterus*, chinch bug; *Melanoplus femurrubrum*, redlegged grasshopper; *Melanoplus sanguinipes*, migratory grasshopper; *Hylemya platura*, seedcorn maggot; *Agromyza parvicornis*, corn blot leafminer; *Anaphothrips obscrurus*, grass thrips; *Solenopsis milesta*, thief ant; *Tetranychus urticae*, twospotted spider mite; Sorghum: *Chilo partellus*, sorghum borer; *Spodoptera frugiperda*, fall armyworm; *Helicoverpa zea*, corn earworm; *Elasmopalpus lignosellus*, lesser cornstalk borer; *Feltia subterranea*, granulate cutworm; *Phyllophaga crinita*, white grub; *Eleodes, Conoderus,* and *Aeolus* spp., wireworms; *Oulema melanopus*, cereal leaf beetle; *Chaetocnema pulicaria*, corn flea beetle; *Sphenophorus maidis*, maize billbug; *Rhopalosiphum maidis*, corn leaf aphid; *Sipha flava*, yellow sugarcane aphid; *Blissus leucopterus leucopterus*, chinch bug; *Contarinia sorghicola*, sorghum midge; *Tetranychus cinnabarinus*, carmine spider mite; *Tetranychus urticae*, twospotted spider mite; Wheat: *Pseudaletia unipunctata*, army worm; *Spodoptera frugiperda*, fall armyworm; *Elasmopalpus lignosellus*, lesser cornstalk borer; *Agrotis orthogonia*, western cutworm; *Elasmopalpus lignosellus*, lesser cornstalk borer; *Oulema melanopus*, cereal leaf beetle; *Hypera punctata*, clover leaf weevil; *Diabrotica undecimpunctata howardi*, southern corn rootworm; Russian wheat aphid; *Schizaphis graminum*, greenbug; *Macrosiphum avenae*, English grain aphid; Melanoplusfemurrubrum, redlegged grasshopper; *Melanoplus differentialis*, differential grasshopper; *Melanoplus sanguinipes*, migratory grasshopper; *Mayetiola destructor*, Hessian fly; Sitodiplosis mosellana, wheat midge; Meromyza americana, wheat stem maggot; *Hylemya coarctata*, wheat bulb fly; Frankliniella-fusca, tobacco thrips; Cephus cinctus, wheat stem sawfly; Aceria *tulipae*, wheat curl mite; Sunflower: Suleima helianthana, sunflower bud moth; Homoeosoma electellum, sunflower moth; Zygogramma exclamationis, sunflower beetle; Bothyrus gibbosus, carrot beetle; Neolasioptera murtfeldtiana, sunflower seed midge; Cotton: *Heliothis virescens*, cotton budworm; *Helicoverpa zea*, cotton bollworm; *Spodoptera exigua*, beet armyworm; *Pectinophora gossypiella*, pink bollworm; *Anthonomus grandis*, boll weevil; *Aphis gossypii*, cotton aphid; *Pseudatomoscelis seriatus*, cotton fleahopper; *Trialeurodes* abutilonea, bandedwinged whitefly; *Lygus lineolaris*, tarnished plant bug; Melanoplusfemurrubrum, redlegged grasshopper; *Melanoplus differentialis*, differential grasshopper; *Thrips tabaci*, onion thrips; *Franklinkiella fusca*, tobacco thrips; *Tetranychus cinnabarinus*, carmine spider mite; *Tetranychus urticae*, twospotted spider mite; Rice: *Diatraea saccharalis*, sugarcane borer; *Spodoptera frugiperda*, fall armyworm; *Helicoverpa zea*, corn earworm; *Colaspis brunnea*, grape *colaspis; Lissorhoptrus oryzophilus*, rice water weevil; *Sitophilus oryzae*, rice weevil; *Nephotettix nigropictus*, rice leafhopper; *Blissus leucopterus leucopterus*, chinch bug; *Acrosternum hilare*, green stink bug; Soybean: *Pseudoplusia includens*, soybean looper; *Anticarsia gemmatalis*, velvetbean caterpillar; *Plathypena scabra*, green cloverworm; *Ostrinia nubilalis*, European corn borer; *Agrotis ipsilon*, black cutworm; *Spodoptera exigua*, beet armyworm; *Heliothis virescens*, cotton budworm; *Helicoverpa zea*, cotton bollworm; *Epilachna varivestis*, Mexican bean beetle; *Myzus persicae*, green peach aphid; *Empoasca fabae*, potato leafhopper; *Acrosternum hilare*, green stink bug; *Melanoplus femurrubrum*, redlegged grasshopper; *Melanoplus differentialis*, differential grasshopper; *Hylemya platura*, seedcorn maggot; *Sericothrips variabilis*, soybean thrips; *Thrips tabaci*, onion thrips; *Tetranychus turkestani*, strawberry spider mite; *Tetranychus urticae*, twospotted spider mite; Barley: *Ostrinia nubilalis*, European corn borer; *Agrotis ipsilon*, black cutworm; *Schizaphis graminum*, greenbug; *Blissus leucopterus leucopterus*, chinch bug; *Acrosternum hilare*, green stink bug; *Euschistus servus*, brown stink bug; *Delia platura*, seedcorn maggot; *Mayetiola destructor*, Hessian fly; *Petrobia latens*, brown wheat mite; Oil Seed Rape: *Brevicoryne brassicae*, cabbage aphid; *Phyllotreta cruciferae*, Flea beetle; *Mamestra configurata*, Bertha armyworm; *Plutella xylostella*, Diamond-back moth; *Delia* ssp., Root maggots.

In some embodiments, the insecticidal compositions can be employed to treat combinations comprising one or more of the foregoing insects.

The insects that are susceptible to the peptides of this invention include but are not limited to the following: Cyt toxins affect familes such as: Blattaria, Coleoptera, Collembola, Diptera, Echinostomida, Hemiptera, Hymenoptera, Isoptera, Lepidoptera, Neuroptera, Orthoptera, Rhabditida, Siphonoptera, Thysanoptera. Genus-Species are indicated as follows: *Actebia-fennica, Agrotis-ipsilon, A.-segetum, Anticarsia-gemmatalis, Argyrotaenia-citrana, Artogeia-rapae, Bombyx-mori, Busseola-fusca, Cacyreus-marshall, Chilo-suppressalis, Christoneura-fumiferana, C.-occidentalis, C.-pinus pinus, C.-rosacena, Cnaphalocrocis-medinalis, Conopomorpha-cramerella, Ctenopsuestis-obliquana, Cydia-pomonella, Danaus-plexippus, Diatraea-saccharallis, D.-grandiosella, Earias-vittella, Elasmolpalpus-lignoselius, Eldana-saccharina, Ephestia-kuehniella, Epinotia-aporema, Epiphyas-postvittana, Galleria-mellonella, Genus-Species, Helicoverpa-zea, H.-punctigera, H-armigera, Heliothis-virescens, Hyphantria-cunea, Lambdina-fiscellaria, Leguminivora-glycinivorella, Lobesia-botrana, Lymantria-dispar, Malacosoma-disstria, Mamestra-brassicae, M configurata, Manduca-sexta, Marasmia-patnalis, Maruca-vitrata, Orgyia-leucostigma, Ostrinia-nubilalis, O.-furnacalis, Pandemis-pyrusana, Pectinophora-gossypiella, Perileucoptera-coffeella, Phthorimaea-operculela, Pianotortrix-octo, Piatynota-stultana, Pieris-brassicae, Plodia-interpunctala, Plutella-xylostella, Pseudoplusia-includens, Rachiplusia-nu, Sciropophaga-incertulas, Sesamia-calamistis, Spilosoma-virginica, Spodoptera-exigua, S.-frugiperda, S.-littoralis, S.-exempta, S.-litura, Tecia-solanivora, Thaumetopoea-pityocampa, Trichoplusia-ni, Wiseana-cervinata, Wiseana-copularis, Wiseana-jocosa, Blattaria-Blattella, Collembola-Xenylla, C.-Folsomia, Echinostomida-Fasciola, Hemiptera-Oncopeltrus, He.-Bemisia, He.-Macrosiphum, He.-Rhopalosiphum, He.-Myzus, Hymenoptera-Diprion, Hy.-Apis, Hy.-Macrocentrus, Hy.-Meteorus, Hy.-Nasonia, Hy.-Solenopsis, Isopoda-Porcello, Isoptera-Reticulitermes, Orthoptera-*

*Achta, Prostigmata-Tetranychus, Rhabitida-Acrobeloides, R.-Caenorhabditis, R.-Distolabrellus, R.-Panagrellus, R.-Pristionchus, R.-Pratylenchus, R.-Ancylostoma, R.-Nippostrongylus, R.-Panagrellus, R.-Haemonchus, R.-Meloidogyne, and Siphonaptera-Ctenocephalides.*

We describe Part II with the following description and summary:

We describe a peptide with an N-terminal dipeptide which is added to and operably linked to a known peptide, wherein said N-terminal dipeptide is comprised of one nonpolar amino acid on the N-terminal of the dipeptide and one polar amino acid on the C-terminal of the dipeptide, wherein said peptide is selected from a CRIP (Cysteine Rich Insecticidal Peptide), such as from an ICK peptide, or a Non-ICK peptide. The N-terminal dipeptide which is added to and operably linked to a known peptide, wherein said N-terminal dipeptide is comprised of one nonpolar amino acid on the N-terminal of the dipeptide and one polar amino acid on the C-terminal of the dipeptide. The N-terminal dipeptide has a non-polar amino acid as the N-terminal amino acid of the N-terminal dipeptide that can be selected from glycine, alanine, proline, valine, leucine, isoleucine, phenylalanine and methionine and a polar amino acid of the C-terminal amino acid of the N-terminal peptide can be selected from serine, threonine, cysteine, asparagine, glutamine, histidine, tryptophan, tyrosine.

The N-terminal dipeptide can have a non-polar amino acid as the N-terminal amino acid of the N-terminal dipeptide selected from glycine, alanine, proline, valine, leucine, isoleucine, phenylalanine and methionine and said polar amino acid of the C-terminal amino acid of the N-terminal peptide is selected from serine, threonine, cysteine, asparagine, glutamine, histidine, tryptophan, tyrosine. The N-terminal dipeptide can and preferably is comprised of glycine-serine.

We describe a peptide with a N-terminal dipeptide which is added to and operably linked to a known peptide, wherein said N-terminal dipeptide is comprised of one nonpolar amino acid on the N-terminal of the dipeptide and one polar amino acid on the C-terminal of the dipeptide, wherein said peptide is selected from a PFIP (Pore Forming Insecticidal Protein), or it could be selected from a CRIP (Cysteine Rich Insecticidal Peptide), such as from an ICK peptide, or a Non-ICK peptide. The Non-ICK peptide could be a sea anemone, origin peptide like Av2 or Av3 and the preferred dipeptide is comprised of glycine-serine. The ICK peptide could be from a spider like the ACTX peptides and the preferred dipeptide is comprised of glycine-serine. The PFIP could be a Bt protein, like any of those disclosed herein, in the sequence listing and know to one skilled in the art who reads these description and the preferred dipeptide is comprised of glycine-serine.

As noted above we explain that the N-terminal dipeptide is comprised of one nonpolar amino acid on the N-terminal of the dipeptide and one polar amino acid on the C-terminal of the dipeptide and the non-polar amino acid from the N-terminal amino acid of the N-terminal dipeptide can be selected from glycine, alanine, proline, valine, leucine, isoleucine, phenylalanine and methionine and preferably the non-polar amino acid is glycine. And we explain and claim that any of the peptides in the paragraph below and any of the peptides in this paragraph can act independently and should be treated independently and all of the possible combinations are claimed independently.

As noted above we explain that the N-terminal dipeptide is comprised of one nonpolar amino acid on the N-terminal of the dipeptide and one polar amino acid on the C-terminal of the dipeptide and the polar amino acid of the C-terminal amino acid of the N-terminal peptide is selected from serine, threonine, cysteine, asparagine, glutamine, histidine, tryptophan, tyrosine and preferably the polar amino acid is serine. And we explain and claim that any of the peptides in the paragraph above and any of the peptides in this paragraph can act independently and should be treated independently and all of the possible combinations are claimed independently.

The peptide to which the N-terminal dipeptide is attached can be any peptide, any toxic peptide, any insecticidal peptide, any PFIP, any CRIP, a CRIP that is a ACTX peptide (which is an example of an ICK peptide), CRIP is a sea anemone peptide (which is an example of a Non-ICK peptide), it can be a PFIP, the PFIP can be a Bt protein, the Bt protein can be cry, cyt, VIP and it can be like any of these peptides as disclosed herein, or in the sequence listing, or known by one skilled in the art who reads these descriptions and understands the document.

We specifically note that these procedures are useful and we claim the procedures themselves and the products of the procedures both as independent claims and as process by product claims for making any insecticidal peptide and in particular any peptide selected from any of the peptides or sources of peptides including *Atrax* or *Hadronyche*, as disclosed herein or elsewhere, as well as any insecticidal peptide with fragments thereof including mature, pre, and pro peptide versions of said peptides and sequence numbers and the peptide in SEQ. ID. NO. 5.

These peptides are useful and the procedures can all be made and used where there is one nonpolar amino acid at the N-terminal end and one polar amino acid at the C-terminal end, and the dipeptide of said non-polar amino acid is selected from glycine, alanine, proline, valine, leucine, isoleucine, phenylalanine and methionine, and it is preferably glycine or gly, and the polar amino acid is selected from serine, threonine, cysteine, asparagine, glutamine, histidine, tryptophan and tyrosin and it is preferably serine or ser. The dipeptide gly-ser is most preferred. The dipeptide can be operably linked to any known peptide, any toxic peptide, any insecticidal peptide, any of the peptides including *Atrax* or *Hadronyche*, disclosed herein any insecticidal peptide with fragments thereof including mature, pre, and pro peptide versions of said peptides and sequence numbers, any mature insecticidal peptide, the toxic peptide comprises SEQ. ID. NO; 6, or the toxic peptide comprises GSQYC VPVDQ PCSLN TQPCC DDATC TQERN ENGHT VYYCR A (SEQ ID NO: 5).

We also describe and claim the dipeptide Gly-Ser, nucleotides encoding the dipeptide Gly-Ser selected from GGT, GGC, GGA, or GGG, any of which encodes Gly, and TCT, TCC, TCA, TCG, AGT, and AGC, any of which encodes Ser, and those nucleotides linked to any of the proteins and the process and the products of the process. We describe and claim these nucleotides which code for these peptides operably linked to the 5' terminus of the DNA sequence encoding any peptide disclosed herein.

We explain and disclose a process for increasing the yield of insecticidal peptides which are produced from yeast expression systems comprising the addition of any dipeptide to the N-terminus of any insecticidal peptide. The process and product by process for increasing the yield used the dipeptide as discussed in the paragraphs above.

We specifically discuss the procedures, products, process and products by process with any insecticidal peptide that inhibits both voltage-gated Calcium channels and Calcium-activated potassium channels in insects, with peptide origins from any species of Australian Funnel-web spider, a spider is selected from the Australian Funnel-web spiders of genus *Atrax* or *Hadronyche*, including *Hadronyche versuta*. We also specifically describe and claim insecticidal peptides that are not ICK motif peptide such as peptides with origins from any species of venomous sea anemone, we refer to the proteins as examples of CRIP motif peptide, that are Non-ICK. We disclose and have tested and show that the procedures work with proteins from the sea anemone genus *Anemonia*, and specifically from selected species, *Anemonia viridis*. We believe to a scientific certainty that the methods will work with insecticidal peptides that contain contains 20-100 amino acids and 2-6 disulfide bonds, and with insecticidal peptide is any insecticidal peptide with at least 50%, 55%, 60%, 65%, 70%, 75%, 80%, 85%, 90%, 95%, 96%, 97%, 98%, or 99% or greater sequence identity to SEQ ID NO 5, SEQ ID NO 6, Av2 and Av3.

We specifically describe and claim the procedures when used with any species of yeast, including but not limited to any species of the genuses *Saccharomyces, Pichia, Kluyveromyces, Hansenula, Yarrowia* or *Schizosaccharomyces* and the species *Saccharomyces* includes any species of *Saccharomyces*, and preferably we disclose the *Saccharomyces* species *Saccharomyces cerevisiae*. We specifically disclose *Saccharomyces cerevisiae* species is selected from following strains: INVSc1, YNN27, S150-2B, W303-1B, CG25, W3124, JRY188, BJ5464, AH22, GRF18, W303-1A and BJ3505. We specifically disclose *Pichia* species including any species of *Pichia* and preferably the *Pichia* species, *Pichia pastoris*, and preferably the *Pichia pastoris* is selected from following strains: Bg08, Y-11430, X-33, GS115, GS190, JC220, JC254, GS200, JC227, JC300, JC301, JC302, JC303, JC304, JC305, JC306, JC307, JC308, YJN165, KM71, MC100-3, SMD1163, SMD1165, SMD1168, GS241, MS105, any pep4 knock-out strain and any prbl knock-out strain, as well as *Pichia pastoris* is selected from following strains: Bg08, X-33, SMD1168 and KM71. We specifically disclose *Kluyveromyces* species includes any species of *Kluyveromyces*, and preferably *Kluyveromyces lactis*, and we teach that the stain of *Kluyveromyces lactis* can be but is not required to be selected from following strains: GG799, YCT306, YCT284, YCT389, YCT390, YCT569, YCT598, MW98-8C, MS1, CBS293.91, Y721, MD2/1, PM6-7A, WM37, K6, K7, 22AR1, 22A295-1, SD11, MG1/2, MSK110, JA6, CMK5, HP101, HP108 and PM6-3C, in addition to *Kluyveromyces lactis* species is selected from GG799 and YCT306.

We specifically describe and claim the procedures when used with any species of yeast, including but not limited to any species of *Hansenula* species including any species of *Hansenula* and preferably *Hansenula polymorpha*. We specifically describe and claim the procedures when used with any species of yeast, including but not limited to any species of *Yarrowia* species including any species of *Yarrowia* and preferably *Yarrowia lipolytica*. We specifically describe and claim the procedures when used with any species of yeast, including but not limited to any species of *Schizosaccharomyces* species including any species of *Schizosaccharomyces* and preferably *Schizosaccharomyces pombe*.

Part 3. In this Part we Describe Combinations of "CRIPS" and "PFIPS."

A large number of venom peptides have been characterized as "insecticidal." However, despite numerous reports, few have found any utility in the market as actual or effective insecticides. In fact, only ω-ACTX-Hv1a has been reported to be toxic by oral administration to the American lone star tick *Amblyomma americanum*. No other spider toxins have been reported to possess oral activity even in the modified gut of ticks. There has been a report that the bioavailability of these peptides may be increased by coupling them to a carrier protein such as snowdrop lectin (*Galanthus nivalis* agglutinin, GNA). Mukherjee, A. K.: Sollod, B. L.; Wikel, S. K.; King, G. F. "Orally active acaricidal peptide tosins from spider venom." *Toxicon* 2006, 47, 182-187. Garlic lectins are reported to increase the absorption of toxins across the insect midgut Fitches, E et al., *Insect Sci.*, 2008, 15, 483-495, Fitches, E., et al., *Insect Biochem. Mol. Biol.* 2008, 38, 905-915. Firches, E. et al., J. Insect Physiol. 2004, 50, 61-71. For example, fusion of the insecticidal spider toxin U2-SGTX-Sf1a (SFI1) to GNA significantly increased its oral toxicity to the tomato moth Laconobia oleracea Down, R. E. et al., *Pest Manag. Sci.* 2006, 62, 77-85, as well as the rice brown planthopper *Nilaparvata lugens* and the peach-potato aphid *Myzus persicae*. Surprisingly, a thioredoxin-ω-HXTX-Hv1a fusion protein was found to be insecticidal in *Helicoverpa armigera* and *Spodoptera littoralis* caterpillars by topical application, Khan, S. A. *Transgenic Res.* 2006, 15, 349-357. (although the fusion protein was applied topically in a solution containing high levels of imidazole, a compound known to have contact insecticidal activity; Pence, R. J. *California Agric.* 1965, 13-15. These efforts and findings clearly indicate the importance of developing means to enhance the oral bioavailability of venom toxins. We think these efforts are also misdirected. In this disclosure we teach that fusion of insecticidal peptides to carrier proteins that bind to the gut of insects is unnecessary. We describe a better way to deliver the "toxin" in insecticidal peptides to insects. Without wishing to be bound by theory, it is our theory that PFIPS, or Pore Forming Insecticidal Proteins, act by selectively binding to receptors in the insect gut. The PFIPS then, in subsequent events, act to disrupt the membrane potential of the epithelial cells lining the gut. When an appropriate CRIP orTMOF is also timely introduced to the gut at the same time the PFIPS are acting on the insect gut, the result is apotosis and death of the cells lining the gut. Thus, the gut lining is broached and simultaneously the venomous peptides, often large peptides isolated from venom, can pass through the gut and sicken or kill the target insect. Surprisingly, insects that have developed resistance to Bt proteins have no defenses and show no resistance at all to even low levels of Bt, when a PFIP like Bt is administered to an insect in combination with CRIP or TMOF, that is a toxic peptide, but one with properties that do not act like a PFIPS such as Bt. We provide data showing that certain combinations of co-adminstered CRIPS and PFIPS can provide more than double the killing and stopping power than would be expected from similar concentration applications of either a CRIP OR PFIPS applied individually.

Examples of a PFIP include the cry and VIP proteins from Bt organisms. Bt proteins like the cry proteins disrupt the insect gut membrane allowing for adventitious infection (sepsis) of the insect by gut flora. In the absence of gut microbes, Bt is not insecticidal. Broderick, Nichole PNAS Vol. 103, No. 41 (2006). Hence one would expect that the mechanism shown to cause Bt mortality (infection) would be mitigated in those insects showing Bt resistance, and it is mitigated in those insects. Bt resistant insects show little gut disruption even when fed high levels of Bt proteins, like cry. What we have surprisingly discovered is that somehow even though these insects guts no longer display the dramatic effects of Bt on the gut, that is they are truly resistant, when they are exposed to insecticidal peptides of a certain type, like the CRIPS and TMOF which have a very different mode of action than PFIPS like Bt, then these very resistant insects have no resistance what so ever. The disappearance of resistance in a "Bt resistant" insect is surprising, and we show this happens, with our data, in the examples provided herein. This result was completely unexpected. Now however we understand, and we can use this knowledge to explain how sublethal amounts of a PFIP protein like Bt, can be "converted" into a lethal cocktail such that if two (2) or more sublethal amounts of insecticidal protein are co-administered, then the combination of proteins becomes lethal to insects which are otherwise thought to be too large, or too resistant to be susceptible to toxic peptides.

It is surprising that insect resistance to PFIPs alone does not confer resistance to the combination of PFIPS with CRIPS and or TMOF. Because of the mechanism of action of the PFIPS one would expect that the PFIP, like a Bt protein, would no longer contribute to the toxic effects of the combination of PFIPS with CRIPS and or TMOF. Instead the opposite happens and the combination has a greater than expected level of activity as shown with our data.

Insects have developed resistance to Bt. Attempts to combat this resistance have resulted in the use of many different subtypes of Bt. We teach here that insect resistance can be overcome by co-application of venom peptides. Since the most common mode of resistance (mode 1, prior ref) Pence, R. J. "The antimetabolite imidazole as a pesticide." *California Agric.* 1965, 13-15. is down regulation of Bt receptors that line the gut, one would expect insect resistance would be maintained in Bt resistant insects because the number of receptors is insufficient to render the insect vulnerable to sepsis by gut flora. What we have discovered and believe, and our data supports our theory in dramatic fashion (see examples below), is that even with Bt resistant insects there remains sufficient membrane abnormalities that exposure to even low levels of Bt, when combined with certain small a "toxic" insecticidal peptides, having a different type of mode of action than Bt, will surprisingly cause Bt resistant insects to stop feeding or die. We believe this is because the gut lining is still disrupted in these resistant insects, just enough, enough to allow the allow passage of the much smaller venom peptides characteristic of either CRIP and TMOF types of insecticidal peptides.

In this document we do not consider TMOF peptides or Trypsin modulating oostatic factor (TMOF) peptides which have been identified as a potential larvicides, see D. Borovsky, Journal of Experimental Biology 206, 3869-3875, to be a CRIP type of insecticidal peptide. We define a CRIP peptide as one with various cysteines according to our definitions herein. TMOF peptides does not fit motif that we describe as a CRIP peptide. Please see the definition section toward the beginning of these documents for a definition of CRIP and TMOF. We discuss combining CRIP and or TMOF type of proteins with a different type of protein we describe as PFIPS.

PFIPS are Pore Forming Insecticidal Proteins which are also defined in the definition section. One example of one type of PFIP are various proteins of the widely used group of proteins derived from Bt, such as cry, cyt and VIP. These are effective insecticides used for crop protection in the form of both plant incorporated protectants and foliar sprays. Commercial formulations of such Bt proteins are widely used to control insects at the larval stage.

In contrast to PFIPS, CRIPS such as Inhibitory cysteine knot or ICK peptides are very different group of peptides that also have insecticidal activity, but they act with a very different mode of action. In this document there is no overlap of a PFIP protein with a CRIP protein, the two groups are separate and distinct. ICK peptides and even Non-ICK peptides are both considered CRIPS in this document. CRIPS are often toxic to naturally occurring biological target species, usually insects or arachnids of some type. Often CRIP peptides can have arthropod origins such as the venoms of scorpions or spiders, this venom origin is very common with ICKs. CRIP may be delivered to their physiological site of action in various ways, for example by delivering the toxin directly to the insect's gut or internal organs by injection, by application to an insect locus and uptake from surface contact, or by inducing the insect to consume the toxin from its food, for example an insect feeding upon a transgenic plant.

The peptides described herein may be formulated as either applied products or through transgenic plants face challenges. It can be difficult to successfully produce such peptides on a commercial scale, with reproducible peptide formation and folding. Cost controls can be challenging. The wide variety, unique properties and special nature of peptides, combined with the huge variety of possible production techniques present an overwhelming number of approaches to peptide production. Commercial products have their own significant challenges. Peptides are often unstable when applied in the environment of a crop. UV irradiation and other factors can cause Bt insecticides to decay rapidly in the environment, often in as little as a few hours. Further, commercial effectiveness can change. Both Bt spray on products and the transgenic Bt proteins used as plant incorporated protectant face emerging insect resistance.

A product is needed that enhances the acute activity, improves resistance performance, or extends the duration of action in order to increase insect control and crop protection.

Here we present combinations of Bt Protein and ICK and TMOF peptides in various combinations. We describe examples of these novel combinations. The new combinations, products, methods, and their formulation and uses thereof are described and claimed herein.

Cysteine Rich Insecticidal Peptides (CRIPS) in Synergistic Combinations

Cysteine rich insecticidal peptides (CRIPS) are peptides rich in cysteine which form disulfide bonds. The cysteine-cysteine disulfide bonds play a significant role in the toxicity of these insecticidal peptides which are exemplified by both inhibitory cysteine knot or ICK peptides and by examples of toxic peptides with disulfide bonds that are not considered ICK peptides (non-ICK CRIPS) such as peptides from the sea anemone, like Av2 and Av3 peptides. These cysteine-cysteine disulfide bonds stabilized toxic peptides (CRIPS) can have remarkable stability when exposed to the environment. Many ICK peptides are isolated from venomous animals such as spiders, scorpions, and snakes and are toxic to insects. TMOF peptides are known to have larvicidal activity. Av2 and Av3 peptides are isolated from sea anemones. We also describe a different group of peptides that act on the lining of the insect gut. We call these PFIPS for Pore Forming Insecticidal Proteins. Most well known examples of a PFIPS are the Bt proteins, well known because of their specific pesticidal activities and commercial applications. Surprisingly, we discovered that, when the combination of these peptides, PFIPS and CRIPS are combined and administered so they act together in the gut (co-administration of the combination not required only the combination of the activity in the gut is needed) they become highly effective at controlling insects. For example, one of the preferred combinations would be to combine a Bt protein with an ICK peptides, or sea anemone peptides they create a highly effective insecticide with a potency much greater than one would expect.

We describe an insecticidal combination peptide composition comprising both a PFIP (Pore Forming Insecticidal Proteins) in combination with a either a CRIP and/or a TMOF type of insecticidal protein. Note that CRIP includes such insecticidal proteins as ICK (Inhibitor Cystine Knot) peptides, and Non-ICK proteins but TMOF peptides are not considered CRIP proteins. CRIP proteins can include Non-ICK proteins like the proteins first identified in sea anemones, for example Av2 or Av3. The composition can be in the ratio of PFIP: to CRIP and or TMOF, on a dry weight basis, from about any or all of the following ratios: 99:1, 95:5, 90:10, 85:15, 80:20, 75:25, 70:30, 65:35, 60:40, 55:45, 50:50, 45:55, 40:60, 35:65, 30:70, 25:75, 20:80, 15:85, 10:90, 5:95 and 1:99, or any combination of any two of these values. We also describe a composition where the ratio of PFIP to CRIP or TMOF on a on a dry weight basis, is selected from about the following ratios: 50:50, 45:55, 40:60, 35:65, 30:70, 25:75, 20:80, 15:85, 10:90, 5:95, 1:99, 0.5:99.5, 0.1:99.9 and 0.01:99.99 or any combination of any two of these values. CRIP, ICK, Non-ICK CRIP and TMOF can be either 100% of the peptide combined with Bt, or either peptide in any combination that totals 100% of both ICK+TMOF peptide can be combined with Bt.

In another embodiment the combination of mixtures of PFIP in combination with CRIP or TMOF peptides includes either or both of the PFIP and CRIP, ICK and non ICK peptides which are derived from more than 1 different types or bacterial strain origins for either one or both of PFIP, ICK and TMOF peptides. By bacterial strain origins we mean the peptides can be described as having been expressed by a bacterial strain that expresses the peptides with the understanding that many peptides are also artificial in the sense that they are no longer all developed from animal or bacterial strains.

We also disclose compositions where either or both of mixtures of PFIP in combination with CRIP or TMOF peptides and or mixtures of PFIP in combination with CRIP plus or with TMOF peptides are derived from between 2 and 5, 2-15, 2-30, 5-10, 5-15, 5-30, 5-50 and various other different types or bacterial strains origins of either one or both of the proteins. We disclose a composition where either or both of the proteins are encoded by from 2 to 15 different types or bacterial strain origins of either one or both of the PFIP in combination with CRIP or TMOF peptides. And any of these combinations of 2-5, 2-15, 2-30, 5-10, 5-15, 5-30, 5-50 and various other different types and mixtures of PFIP in combination with CRIP or TMOF peptides can contribute more than at least 1% of each strain type to the composition.

We disclose compositions of Bt and ICK, Bt and TMOF peptides or BT and ICK+TMOF peptides where the total concentration of Bt and ICK peptide, Bt and TMOF peptides or BT and ICK+TMOF peptides in the composition is selected from the following percent concentrations: 0, 1, 5, 10, 15, 20, 25, 30, 35, 40, 45, 50, 55, 60, 65, 70, 75, 80, 85, 90, 95, 99 or 100%, or any range between any two of these values, and the remaining percentage of the composition is comprised of excipients. We disclose compositions wherein the insecticidal combination peptide is produced using a genetic cassette that further comprises an ERSP (Endoplasmic Reticulum Signal Peptide) operably linked to the insecticidal ICK peptide, wherein said ERSP is linked at the N-terminal of the insecticidal ICK peptide. We disclose compositions wherein the insecticidal combination peptide is produced using a genetic cassette that further comprises an ERSP (Endoplasmic Reticulum Signal Peptide) operably linked to the insecticidal ICK peptide, wherein said ERSP is linked at the N-terminal of the insecticidal ICK peptide, wherein the ERSP is BAAS.

We disclose compositions wherein said combination of peptides is produced using a genetic cassette that further comprises a dipeptide operably linked to the insecticidal ICK and of TMOF peptide, wherein said dipeptide is linked at the N-terminal of the insecticidal ICK peptide; and wherein the dipeptide is comprised of one nonpolar amino acid on the N-terminal of the dipeptide and one polar amino acid on the C-terminal of the dipeptide, including embodiments where the dipeptide is glycine-serine, including embodiments where the insecticidal ICK peptide is any insecticidal peptide that inhibits both voltage-gated Calcium channels and Calcium-activated potassium channels in insects, including embodiments where the insecticidal ICK peptide origins from any species of Australian Funnel-web spider, including embodiments where the spider is selected from the Australian Funnel-web spiders of genus *Atrax* or *Hadronyche*, including embodiments where the spider is selected from the Australian Funnel-web spiders of genus *Hadronyche*, including embodiments where the spider is selected from the Australian Blue Mountains Funnel-web, *Hadronyche versuta*, including embodiments where the insecticidal ICK peptide is Hybrid-ACTX-Hv1a, including embodiments where the insecticidal ICK peptide contains 20-100 amino acids and 2-4 disulfide bonds, including embodiments where said insecticidal ICK peptide is any insecticidal peptide with at least 50%, 55%, 60%, 65%, 70%, 75%, 80%, 85%, 90%, 95%, 96%, 97%, 98%, or 99% or greater sequence identity to any of the ICK sequences disclosed herein, including embodiments where the insecticidal ICK peptide is selected from publications incorporated by reference, including embodiments where the Bt protein is any insecticidal Bt protein, including embodiments where the Bt protein is a Cry or Cyt protein, including embodiments where the Bt protein is selected from the group consisting of a Cry1, Cry3, TIC851, CryET70, Cry22, TIC901, TIC201, TIC407, TIC417, a binary insecticidal protein CryET80, and CryET76, a binary insecticidal protein TIC100 and TIC101, a combination of an insecticidal protein ET29 or ET37 with an insecticidal protein TIC810 or TIC812 and a binary insecticidal protein PS149B1, including embodiments where the Bt protein is selected from a Cry protein, a Cry1A protein or a Cry1F protein, including embodiments where the Bt protein is a combination Cry1F-Cry1A protein, including embodiments where the Bt protein comprises an amino acid sequence at least 90% identical to SEQ ID NO: 10, 12, 14, 26, 28, or 34 of U.S. Pat. No. 7,304,206, including embodiments where the Bt Protein is DIPEL®, including embodiments where the Bt protein is THURICIDE®.

We disclose a composition comprising the nucleotides of: Bt (*Bacillus thuringiensis*) protein; and an insecticidal ICK (Inhibitor Cystine Knot) peptide, Bt and TMOF peptide or BT and ICK+TMOF peptides in a transformed plant or plant genome; where the ratio of Bt to ICK, Bt and TMOF peptides or BT and ICK+TMOF peptides, on a dry weight basis, is selected from about the following ratios: 99:1, 95:5, 90:10, 85:15, 80:20, 75:25, 70:30, 65:35, 60:40, 55:45, 50:50, 45:55, 40:60, 35:65, 30:70, 25:75, 20:80, 15:85, 10:90, 5:95 and 1:99, or any combination of any two of these values.

We disclose transformed plant or plant genome wherein the ratio of Bt to ICK, Bt and TMOF peptides or BT and ICK+TMOF peptides on a dry weight basis, is selected from about the following ratios: 50:50, 45:55, 40:60, 35:65, 30:70, 25:75, 20:80, 15:85, 10:90, 5:95, 1:99, 0.5:99.5, 0.1:99.9 and 0.01:99.99 or any combination of any two of these values. The transformed plant or plant genome may have either or both of the Bt and ICK peptides are derived from more than 1 different type or bacterial strain origin of Bt or ICK peptides, or either or both of the Bt and ICK peptides are derived from between 2 and 5 different type or bacterial strain origin of either Bt or ICK peptides or both Bt and ICK peptides are derived from between 2 and 5 different types or strain origins, or either or both of the Bt and ICK peptides are derived from 2 to 15 different type or bacterial strain origins of either or both of Bt and ICK peptides and at least one strain of either Bt or ICK or both Bt and ICK peptides encoded by more than one copy of the Bt or ICK genes, or either or both of the Bt and ICK peptides are derived from more than one different type or bacterial strain origin of Bt and/or ICK peptides where all the strains of Bt and/or ICK peptides contribute more than at least 1% of each strain type to said composition, or either or both of the Bt and ICK peptides are derived from 2 to 5 different type or bacterial strain origins of either or both of Bt and ICK peptides and at least one strain of either Bt or ICK or both Bt and ICK peptides encoded by more than one copy of the Bt of ICK genes, or the total concentration of Bt and ICK peptide in the composition can be selected from the following percent concentrations: 0, 1, 5, 10, 15, 20, 25, 30, 35, 40, 45, 50, 55, 60, 65, 70, 75, 80, 85, 90, 95, 99 or 100%, or any range between any two of these values, and the remaining percentage of the composition is comprised of excipients.

The compositions and plants described herein include an insecticidal combination peptide produced using a genetic cassette that further comprises an ERSP (Endoplasmic Reticulum Signal Peptide) operably linked to the insecticidal ICK peptide, or to a TMOF peptide wherein said ERSP is linked at the N-terminal of the insecticidal ICK or TMOF peptide. In another embodiment the insecticidal combination peptide is produced using a genetic cassette that further comprises an ERSP (Endoplasmic Reticulum Signal Peptide) operably linked to the insecticidal ICK peptide, wherein said ERSP is linked at the N-terminal of the insecticidal ICK peptide, wherein the ERSP is BAAS. In another embodiment the transgenic plant incorporating and expressing the combination peptides from the nucleotides described herein, wherein said combination peptide is produced using a genetic cassette that further comprises nucleotides expressing a dipeptide operably linked to the insecticidal ICK or TMOF peptide, wherein said dipeptide is linked at the N-terminal of the insecticidal ICK peptide; and wherein the dipeptide is comprised of one nonpolar amino acid on the N-terminal of the dipeptide and one polar amino acid on the C-terminal of the dipeptide. In another embodiment the transgenic plant has a dipeptide that glycine-serine. In another embodiment the transgenic plant has insecticidal ICK peptides expressed that are comprised of an insecticidal peptide combination of ICK and Bt proteins. The transgenic plants can have an insecticidal ICK peptide derived from any species of Australian Funnel-web spider, or the Australian Funnel-web spiders of genus *Atrax* or *Hadronyche*, and the Australian Blue Mountains Funnel-web, *Hadronyche versuta*.

We describe and claim a transgenic plant wherein the insecticidal ICK peptide expressed is Hybrid-ACTX-Hv1a, and or the insecticidal ICK peptide expressed may contain 20-100 amino acids and 2-4 disulfide bonds and or the insecticidal ICK peptide is any insecticidal peptide with at least 50%, 55%, 60%, 65%, 70%, 75%, 80%, 85%, 90%, 95%, 96%, 97%, 98%, or 99% or greater sequence identity to any of the ICK peptides described herein. The transgenic plants disclosed can contain any known Bt protein, including peptides where the Bt protein is a Cry or Cyt protein, and/or the Bt protein is selected from the group consisting of a Cry1, Cry3, TIC851, CryET70, Cry22, TIC901, TIC201, TIC407, TIC417, a binary insecticidal protein CryET80, and CryET76, a binary insecticidal protein TIC100 and TIC101, a combination of an insecticidal protein ET29 or ET37 with an insecticidal protein TIC810 or TIC812 and a binary insecticidal protein PS149B1. The Bt protein can be selected from a Cry protein, a Cry1A protein or a Cry1F protein, or a combination Cry1F-Cry1A protein, or it comprises an amino acid sequence at least 90% identical to sequences 10, 12, 14, 26, 28, or 34 of U.S. Pat. No. 7,304,206. We describe a transgenic plant wherein the Bt protein is DIPEL® and we describe a transgenic plant wherein the Bt protein is THURICIDE®.

We specifically describe and claim a transformed plant expressing the peptides described herein where the average concentration of Bt and ICK peptide, Bt and TMOF peptides or BT and ICK+TMOF peptides, in an average leaf of a transformed plant is about: 1, 5, 10, 15, 20, 25, 30, 35, 40, 45, 50, 55, 60, 65, 70, 75, 80, 85, 90, 95 or 99%, or any range between any two of these values. We specifically describe and claim a transformed plant expressing properly folded toxic peptides in the transformed plant. We specifically describe and claim a transformed plant expressing properly folded combination toxic peptides in the transformed plant and to cause the accumulation of the expressed and properly folded toxic peptides in said plant and to cause an increase in the plant's yield or resistance to insect damage and they control insect pests in crops and forestry. We describe plants made by any of the products and processes described herein.

We describe expression cassettes comprising any of the nucleotides which express any peptides described herein, including embodiments having a functional expression cassette incorporated into a transformed plant, comprising nucleotides that code for any of the peptides disclosed herein or that could be made by one skilled in the art given the teaching disclosed herein. We describe and claim procedures for the generation of transformed plants having or expressing any of the peptides described herein.

We describe the use of any of the peptides or nucleotides described herein, to make a plant or transform these peptides or nucleotides into a plant, and methods and techniques for generating these proteins in plants and/or expression cassettes comprising any of the peptides and methods to transform them into a plant genome and any method of using, making, transforming any of the described peptides or nucleotides into a plant and methods and techniques for generating transformed plants having or expressing any of the peptides and functional expression cassettes in plants comprising any of the disclosed peptides and their corresponding nucleotides and any plants made by the products and processes described herein.

In some embodiments we disclose a chimeric gene comprising a promoter active in plants operatively linked to the nucleic acids or expression cassettes as described herein. We disclose a method of making, producing, or using the combination of genes described herein. We disclose a recombinant vector comprising the combination of genes described herein. We disclose a method of making, producing, or using the recombinant vector. We disclose a transgenic host cell comprising the combination of genes described herein and the method of making, producing or using the transgenic host cell, which can be a transgenic plant cell and we disclose a method of making, producing or using such a transgenic plant cell as well as the transgenic plant comprising the transgenic plant cell and how to make and use the transgenic plant. We disclose transgenic plant and seed having the properties described herein that is derived from corn, soybean, cotton, rice, sorghum, switchgrass, sugarcane, alfalfa, potatoes or tomatoes. The transgenic seed may have a chimeric gene that we describe herein. We describe methods of making, producing or using the transgenic plant and or seed of this disclosure.

We also describe methods of using the invention and provide novel formulations. The invention is most useful to control insects. We describe a method of controlling an insect comprising: Applying Bt (*Bacillus thuringiensis*) protein to said insect; and Applying an insecticidal ICK (Inhibitor Cystine Knot) peptide to said insect. This method may be used where the Bt protein and the insecticidal ICK peptide, Bt and TMOF peptides or BT and ICK +TMOF peptides are applied together at the same time in the same compositions or separately in different compositions and at different times. The Bt protein and the insecticidal ICK peptide, and or TMOF peptide may be applied sequentially, and it may be applied to (Bt protein)-resistant insects. The ratio of Bt to ICK or TMOF, on a dry weight basis, can be selected from at least about the following ratios: 99:1, 95:5, 90:10, 85:15, 80:20, 75:25, 70:30, 65:35, 60:40, 55:45, 50:50, 45:55, 40:60, 35:65, 30:70, 25:75, 20:80, 15:85, 10:90, 5:95 and 1:99, or any combination of any two of these values. The ratio of Bt to ICK, on a dry weight basis, can be selected from about the following ratios: 50:50, 45:55, 40:60, 35:65, 30:70, 25:75, 20:80, 15:85, 10:90, 5:95, 1:99, 0.5:99.5, 0.1:99.9 and 0.01:99.99 or any combination of any two of these values. Either or both of the Bt and ICK peptides are derived from more than 1 different types or bacterial strain origins of Bt and ICK peptides, Bt and TMOF peptides or BT and ICK+TMOF peptides. Either or both of the Bt and ICK, Bt and TMOF peptides or BT and ICK+TMOF peptides are derived from between 2 and 5 different types or bacterial strain origins of either Bt or ICK peptides or both Bt and ICK peptides. Either or both of the Bt and ICK peptides are derived from 2 to 15 different types or bacterial strain origins of either or both of Bt and ICK peptides and at least one strain of either Bt or ICK or both Bt and ICK peptides are encoded by more than one copy of the Bt or ICK genes. Either one or both of the Bt and ICK peptides are derived from more than 1 different types or bacterial strain origins of Bt and/or ICK peptides with all the strains of Bt and/or ICK peptides contributing more than at least 1% of the peptides from each strain type in said composition. Either or both of the Bt and ICK peptides are derived from 2 to 5 different types or bacterial strain origins of either one or both of Bt and ICK peptides and at least one strain of either Bt or ICK or both Bt and ICK peptides are encoded by more than one copy of the Bt or ICK genes. The total concentration of Bt and ICK, Bt and TMOF peptides or BT and ICK+TMOF peptides peptide in the composition is selected from the following percent concentrations: 0, 1, 5, 10, 15, 20, 25, 30, 35, 40, 45, 50, 55, 60, 65, 70, 75, 80, 85, 90, 95, 99 or 100%, or any range between any two of these values, and the remaining percentage of the composition is comprised of excipients.

The methods can be used where the insecticidal combination peptide is produced using a genetic cassette that further comprises an ERSP (Endoplasmic Reticulum Signal Peptide) operably linked to the insecticidal ICK peptide, or TMOF peptide; wherein said ERSP is linked at the N-terminal of the insecticidal ICK peptide. In some embodiments the insecticidal combination peptides used are produced using a genetic cassette that further comprises an ERSP (Endoplasmic Reticulum Signal Peptide) operably linked to the insecticidal ICK peptide, wherein said ERSP is linked at the N-terminal of the insecticidal ICK peptide, wherein the ERSP is BAAS.

Any of the peptides and plants described herein can be used to control insects, their growth and damage, especially their damage to plants. The combination Bt protein and insecticidal ICK peptide can be applied by being sprayed on a plant, or the insect's locus, or the locus of a plant in need of protecting.

We also describe formulations comprising: Bt protein; and an insecticidal ICK, and or an insecticidal TMOF peptide which can include any of the compositions described herein or capable of being made by one skilled in the art given this disclosure. Some of the described formulations include the use of a polar aprotic solvent, and or water, and or where the polar aprotic solvent is present in an amount of 1-99 wt %, the polar protic solvent is present in an amount of 1-99 wt %, and the water is present in an amount of 0-98 wt %. The formulations include formulations where the Bt protein is DIPEL® and where the insecticidal ICK peptide is a hybrid-ACTX-Hv1a peptide. The polar aprotic solvent formulations are especially effective when they contain MSO. MSO is a methylated seed oil and surfactant blend that uses methyl esters of soya oil in amounts of between about 80 and 85 percent petroleum oil with 15 to 20 percent surfactant.

This disclosure provides numerous examples of suitable CRIP type peptides, ICK peptides, NON-ICK CRIP peptides, and TMOF peptides in addition to many type of PFIP type peptides such as Bt and VIP proteins and peptides, when combined, provide novel insecticidal products, and these may be referred to herein as "combination peptides." Peptides suitable for use with this invention are described in this document, and specific examples are disclosed in the sequence listing. The peptides in the sequence listing are provided only as examples to illustrate the invention and to provide direction and meaning for one skilled in the art. It should be understood that the sequence listing does not provide a full and complete list of all CRIPS, ICKs, NON-ICK CRIPS, and TMOF nor does it provide a full and complete list of all PFIPS. Insects may be treated with combination peptides applied directly, such as sprayed onto an insect or its locus, or the combination peptides can be applied indirectly, such as delivered in a transgenic plant. First we provide detailed written descriptions and examples of CRIP peptides like ICK (Section I), and these are also provided above. Then we provide detailed written descriptions and examples of TMOF peptide (Section II). Next we provide detailed written descriptions and examples of Bt proteins (Section III). It should be understood that the application provides these examples as a means to illustrate and not limit the bounds of the patent and the claimed invention. Any suitable Bt protein and ICK peptide or TMOF peptide could be combined in the manner described and result in an effective insecticide. After describing the ICK and Bt proteins, applicant describes various pesticide compositions (Section IV). Plant transformations using both ICK and Bt proteins are described (Section V). Descriptions and examples of CRIP and Bt Combinations (Section VI). TMOF and Bt proteins combinations are described (SectionVII). We provide non limiting examples and descriptions of how the ICK and Bt proteins have been combined to produce a highly effective insecticide, with results and data provided herein.

Section I. The ICK Motif Peptides or ICK Peptides.

"ICK motif," "ICK motif protein," "inhibitor cystine knot motif," "Toxic insect ICK peptides" or "ICK peptides" means a 16 to 60 amino acid peptide with at least 6 half-cystine core amino acids having three disulfide bridges, wherein the 3 disulfide bridges are covalent bonds and of the six half-cystine residues the covalent disulfide bonds are between the first and fourth, the second and fifth, and the third and sixth half-cystines, of the six core half-cystine amino acids starting from the N-terminal amino acid. The ICK motif also comprises a beta-hairpin secondary structure, normally composed of residues situated between the fourth and sixth core half-cystines of the motif, the hairpin being stabilized by the structural crosslinking provided by the motif's three disulfide bonds. Note that additional cysteine/cystine or half-cystine amino acids may be present within the inhibitor cystine knot motif.

This motif is common in peptides isolated from the venom of numerous species. Invertebrate species include spiders and scorpions, other examples are numerous, even snake venom has been known to have peptides having the ICK motif Specific examples of insecticidal ICK peptides are the "U peptides" disclosed herein and in published patents and patent applications and its homologies, which have an origin from the venoms of Australian Funnel-web spiders. These proteins are also referred to as ACTX peptides from the Australian Blue Mountains Funnel-web Spider, but the procedures described herein are useful and may be applied to any protein with the ICK motif. The following documents are incorporated by reference in the United States in their entirety, are known to one skilled in the art, and have all been published.

Examples of peptide toxins with the ICK motif protein can be found in the following references. The N-type calcium channel blocker ω-Conotoxin was reviewed by Lew, M. J. et al. "Structure-Function Relationships of ω-Conotoxin GVIA" Journal of Biological Chemistry, Vol. 272, No. 18, Issue of May 2, pp. 12014-12023, 1997. A summary of numerous arthropod toxic ICK peptides different spider and scorpion species was reviewed in, Quintero-Hemandez, V. et al. "Scorpion and Spider Venom Peptides: Gene Cloning and Peptide Expression" Toxicon, 58, pp. 644-663, 2011. The three-dimensional structure of Hanatoxin1 using NMR spectroscopy was identified as an inhibitor cystine knot motif in Takahashi, H. et al. "Solution structure of hanatoxin1, a gating modifier of voltage-dependent K+ channels: common surface features of gating modifier toxins" Journal of Molecular Biology, Volume 297, Issue 3, 31 Mar. 2000, pp. 771-780. The isolation and identification of cDNA encoding a scorpion venom ICK toxin peptide, Opicalcinel, was published by Zhu, S. et al. "Evolutionary origin of inhibitor cystine knot peptides" FASEB J., 2003 Sep. 17, (12):1765-7, Epub 2003 Jul. 3. The sequence-specific assignment and the secondary structure identification of BgK, a K+ channel-blocking toxin from the sea anemone *Bunodosoma granulifera*, was disclosed by Dauplais, M. et al. "On the convergent evolution of animal toxins" Journal of Biological Chemistry. 1997 Feb. 14; 272(7): 4302-9. A review of the composition and pharmacology of spider venoms with emphasis on polypeptide toxin structure, mode of action, and molecular evolution showing cystine bridges, cystine knot formations and the "knotting-type" fold was published by Escoubas, P. et al. "Structure and pharmacology of spider venom neurotoxins" Biochimie, Vol. 82, Issues 9-10, 10 Sep. 2000, pp. 893-907. The purified peptide, iberiotoxin, an inhibitor of the $Ca^{2+}$-activated $K^+$ channel, from scorpion (*Buthus tamulus*) venom was disclosed in Galvez, A. et al. "Purification and characterization of a unique, potent, peptidyl probe for the high conductance calcium-activated potassium channel from venom of the scorpion *Buthus tamulus*" Journal of Biological Chemistry, 1990 Jul. 5; 265(19): 11083-90. The purified peptide, charybdotoxin, an inhibitor of the $Ca^{2+}$-activated $K^+$ channel, from the venom of the scorpion *Leiurus quinquestriatus* was disclosed in Gimenez-Gallego, G. et al. "Purification, sequence, and model structure of charybdotoxin, a potent selective inhibitor of calcium-activated potassium channels" Proc Natl Acad Sci, 1988 May; 85(10): 3329-3333. From these and other publications, one skilled in the art should be able to readily identify proteins and peptides having what we describe as the ICK motif, ICK motif protein or the "inhibitor cystine knot motif."

The ICK motif protein can be any protein with the ICK motif and is between 16 and 60 amino acids in length, with at least 6 cysteine residues that create covalent cross-linking disulfide bonds in the proper order. Some ICK motif peptides have between 26-60 amino acids in length. Some ICK motif proteins are between 16-48 amino acids in length. Some ICK motif proteins are between 26-48 amino acids in length. Some ICK motif proteins are between 30-44 amino acids in length. ICK motif proteins with natural insecticidal activity are preferred but ICK motif proteins with other types of activity such as salt and frost resistance are known to those skilled in the art and are claimed herein. Examples of insecticidal ICK motif proteins include the ACTX peptides and genes, and including all of the peptides and their coding genes known as Magi6.

Examples of insecticidal ICK motif proteins include the ACTX peptides and genes and include all of the peptides and their coding genes as described in the references provided above and herein. Specific examples of ICK motif proteins and peptides disclosed for purposes of providing examples and not intended to be limiting in any way, are the peptides and their homologies as described above, and in particular peptides and nucleotides which originate from the venoms of Australian Funnel-web spiders. The following documents are incorporated by reference in the United States in their entirety, are known to one skilled in the art, and have all been published. They disclose numerous ICK motif proteins which, their full peptide sequence, their full nucleotide sequence, are specifically disclosed and are incorporated by reference, and in addition the full disclosures are incorporated by reference including all of their sequence listings. Their sequence listings are known and published. See the following: U.S. Pat. No. 7,354,993 B2, issued Apr. 8, 2008, specifically the peptide and nucleotide sequences listed in the sequence listing, and numbered SEQ ID NOs: 33-71, from 7,354,993 B2, and those named U-ACTX polypeptides, and these and other toxins that can form 2 to 4 intra-chain disulfide bridges, and variants thereof, and the peptides appearing on columns 4 to 9 and in FIG. 2 of 7,354,993 B2. Other specific sequences can be found in EP patent 1 812 464 B1, published and granted 08.10.2008, see Bulletin 2008/41, specifically the peptide and nucleotide sequences listed in the sequence listing, and other toxins that can form 2 to 4 intra-chain disulfide bridges, and those sequences numbered SEQ ID NOs: 33-71, and sequences named U-ACTX polypeptides, and variants thereof, and the peptides appearing in paragraphs 0023 to 0055, and appearing in EP patent 1 812 464 B1, see FIG. 1 of EP 1, 1 812 464 B1.

Described and incorporated by reference in order to disclose the peptides identified herein are homologous variants of sequences mentioned, having homology to such sequences or referred to herein, which are also identified and claimed as suitable for making special according to the processes described herein, including all homologous sequences having at least any of the following percent identities to any of the sequences disclosed here or to any sequence incorporated by reference: 50%, 55%, 60%, 65%, 70%, 75%, 80%, 85%, 90%, 95%, 96%, 97%, 98%, or 99% or greater identity or 100% identity to any and all sequences identified in the patents noted above, and to any other sequence identified herein, including each and every sequence in the sequence listing of this application. When the term homologous or homology is used herein with a number such as 50% or greater, then what is meant is percent identity or percent similarity between the two peptides. When homologous or homology is used without a numeric percent then it refers to two peptide sequences that are closely related in the evolutionary or developmental aspect in that they share common physical and functional aspects, like topical toxicity and similar size (i.e., the homolog being within 100% greater length or 50% shorter length of the peptide specifically mentioned herein or identified by reference herein as above).

Described and incorporated by reference to describe the peptides identified herein are toxic ICK peptides including the following: the U peptide and its variants; found in, isolated from, or derived from, spiders of the genus *Atrax* or *Hadronyche*, including the genus species, *Hadronyche versuta*, or the Blue Mountain funnel web spider, *Atrax robustus, Atrax formidabilis, Atrax infensus*, including toxins known as U-ACTX polypetides, U-ACTX-Hv1a, rU-ACTX-Hv1a, rU-ACTX-Hv1b, or mutants or variants, especially peptides of any of these types and especially those less than about 200 amino acids but greater than about 10 amino acids, and especially peptides less than about 150 amino acids but greater than about 20 amino acids, especially peptides less than about 100 amino acids but greater than about 25 amino acids, especially peptides less than about 65 amino acids but greater than about 25 amino acids, especially peptides less than about 55 amino acids but greater than about 25 amino acids, especially peptides of about 37 or 39 or about 36 to 42 amino acids, especially peptides with less than about 55 amino acids but greater than about 25 amino acids, especially peptides with less than about 45 amino acids but greater than about 35 amino acids, especially peptides with less than about 115 amino acids but greater than about 75 amino acids, especially peptides with less than about 105 amino acids but greater than about 85 amino acids, especially peptides with less than about 100 amino acids but greater than about 90 amino acids, including peptide toxins of any of the lengths mentioned here that can form 2, 3 and or 4 or more intrachain disulfide bridges, including toxins that disrupt calcium channel currents, including toxins that disrupt potassium channel currents, especially toxins that disrupt insect calcium channels or Us thereof, especially toxins or variants thereof of any of these types, and any combination of any of the types of toxins described herein that have oral or topical insecticidal activity, can be made special by the processes described herein.

The U peptides from the Australian Funnel Web Spider, genus *Atrax* and *Hadronyche* are particularly suitable and work well when placed in combination according to the methods, procedures or processes described by this invention. Examples of such suitable peptides tested and with data are provided herein. The following species are also specifically known to carry toxic ICK peptides suitable for being made special by the process of this invention. The following species are specifically named: *Atrax formidabillis, Atrax infensus, Atrax robustus, Hadronyche infensa, Hadronyche versuta*. Any toxic ICK peptides derived from any of the genus listed above and/or genus species and homologous to the U peptide are suitable for being made special according to the process in this invention.

The Examples in this specification are not intended to, and should not be used to limit the invention, they are provided only to illustrate the invention.

As noted above, many peptides are suitable candidates for combinations with Bt protein. The sequences noted above, below and in the sequence listing are especially suitable peptides that can be made special, and some of these have been made special according to this invention with the results shown in the examples below.

Examples of toxic ICK insect peptides are well known and can be found in numerous references. They can be identified by their peptidic nature and their activity, usually oral or injection insecticidal activity. Here we provide a few examples to better illustrate and describe the invention, but the invention is not limited to these examples. All of these examples and others not shown here are descriptive of new materials, described and claimed here for the first time.

Toxic ICK insect peptides are peptides of greater than 5 amino acid residues and less than 3,000 amino acid residues. They range in molecular weight from about 550 Da to about 350,000 Da. Toxic ICK insect peptides have some type of insecticidal activity. Typically they show activity when injected into insects but most do not have significant activity when applied to an insect topically. The insecticidal activity of toxic ICK insect peptides is measured in a variety of ways. Common methods of measurement are widely known to those skilled in the art. Such methods include, but are not limited to determination of median response doses (e.g., $LD_{50}$, $PD_{50}$, $LC_{50}$, $ED_{50}$) by fitting of dose-response plots based on scoring various parameters such as: paralysis, mortality, failure to gain weight, etc. Measurements can be made for cohorts of insects exposed to various doses of the insecticidal formulation in question. Analysis of the data can be made by creating curves defined by probit analysis and/or the Hill Equation, etc. In such cases, doses would be administered by hypodermic injection, by hyperbaric infusion, by presentation of the insecticidal formulation as part of a sample of food or bait, etc.

Toxic ICK insect peptides or ICK peptides are defined here as all peptides shown to be insecticidal upon delivery to insects either by hypodermic injection, hyperbaric infusion, or upon per os delivery to an insect (i.e., by ingestion as part of a sample of food presented to the insect). This class of peptides thus comprises, but is not limited to, many peptides produced naturally as components of the venoms of spiders, mites, scorpions, snakes, snails, etc. This class also comprises, but is not limited to, various peptides produced by plants (e.g., various lectins, ribosome inactivating proteins, and cysteine proteases), and various peptides produced by entomopathogenic microbes (e.g. the Cry1/Bt protein family of proteins produced by various *Bacillus* species.)

The insecticidal peptides may be selected from insecticidal venom, for example the venom of a spider. The spider may be an Australian funnel web spider. The peptides from may be from the genus of *Atrax* or *Hadronyche*, including U-ACTX-Hv1a and its analogs. Specific peptide examples from spiders are described in the sequence listing provided herein. These peptides can be combined with Bt protein using the procedures described herein.

ICK Peptide Sequence Examples

The following documents are incorporated by reference in the US in their entirety, in other jurisdictions where allowed and they are of common knowledge given their publication. In addition they are incorporated by reference and known specifically for their sequence listings to the extent they describe peptide sequences. See the following: US Patents:

U.S. Pat. No. 5,763,568, issued Jun. 9, 1998, incorporated herein in its entirety, specifically the sequences in the sequence listing, and those numbered 33-58, and those known as "kappa" or "omega" toxins, including those that can form 2-4 intrachain disulphide bridges, and the peptides appearing on columns 2 and 4, and Table 5, and in FIG. 5, FIG. 15, FIG. 16, FIG. 17, FIG. 18.

U.S. Pat. No. 5,959,182, issued Sep. 28, 1999, incorporated herein in its entirety, specifically the sequences in the sequence listing, and those numbered 33-58 and those known as "kappa" or "omega" toxins, including toxins that can form 2-4 intrachain disulphide bridges, and the peptides appearing on columns 2 and 4, and Table 5, and in FIG. 5, FIG. 15, FIG. 16, FIG. 17, FIG. 18.

U.S. Pat. No. 6,583,264 B2, issued Jun. 24, 2003, and U.S. Pat. No. 7,173,106 B2, issued Feb. 6, 2007, incorporated herein in its entirety, specifically sequence number 1, named "omega-atracotoxin-Hv2a or ω-atracotoxin-Hv2a, including toxins that can form 2-4 intrachain disulphide bridges.

U.S. Pat. No. 7,279,547 B2, issued Oct. 9, 2007, incorporated herein in its entirety, specifically the sequences in the sequence listing, and those numbered 33-67, and variants of ω-atracotoxin-Hv2a, toxins that can form 2-4 intrachain disulphide bridges, and the peptides appearing on columns 4-8 of the specification, and in FIG. 3 and FIG. 4.

U.S. Pat. No. 7,354,993 B2, issued Apr. 8, 2008, incorporated herein in its entirety, specifically the peptide sequences listed in the sequence listing, and those numbered 33-71, and those named U-ACTX polypeptides, toxins that can form 2-4 intrachain disulphide bridges, and variants thereof, and the peptides appearing on columns 4-9 of the specification and in FIG. 1.

EP patent 1 812 464 B1, published and granted 08.10.2008 Bulletin 2008/41, incorporated herein in its entirety, specifically the peptide sequences listed in the sequence listing, toxins that can form 2-4 intrachain disulphide bridges, and those as numbered 33-71, and those named U-ACTX polypeptides, and variants thereof, and the peptides appearing in paragraphs 0023 to 0055, and appearing in FIG. 1.

Described and incorporated by reference to the peptides identified herein are homologous variants of sequences mentioned, have homology to such sequences or referred to herein which are also identified and claimed as suitable for making special according to the processes described herein including but not limited to all homologous sequences including homologous sequences having at least any of the following percent identities to any of the sequences disclosed her or to any sequence incorporated by reference: 30%, 35%, 40%, 45%, 50%, 55%, 60%, 65%, 70%, 75%, 80%, 85%, 90% or 95% or greater identity to any and all sequences identified in the patents noted above, and to any other sequence identified herein, including each and every sequence in the sequence listing of this application. When the term homologous or homology is used herein with a number such as 30% or greater then what is meant is percent identity or percent similarity between the two peptides. When homologous or homology is used without a numeric percent then it refers to two peptide sequences that are closely related in the evolutionary or developmental aspect in that they share common physical and functional aspects like topical toxicity and similar size within 100% greater length or 50% shorter length or peptide.

Described and incorporated by reference to the peptides identified herein that are derived from any source mentioned in the US and EP patent documents referred to above, including but not limited to the following: toxins isolated from plants and insects, especially toxins from spiders, scorpions and plants that prey on or defend themselves from insects, such as, funnel web spiders and especially Australian funnel web spiders, including toxins found in, isolated from or derived from the genus Atrax or Hadronyche, including the genus species, Hadronyche versuta, or the Blue Mountain funnel web spider, Atrax robustus, Atrax formidabilis, Atrax infensus including toxins known as "atracotoxins," "cω-atracotoxins," "kappa" atracotoxins, "omega" atracotoxins also known as ω-atracotoxin, U-ACTX polypeptides, U-ACTX-Hv1a, rU-ACTX-Hv1a, rU-ACTX-Hv1b, or mutants or variants, especially peptides of any of these types and especially those less than about 200 amino acids but greater than about 10 amino acids, and especially peptides less than about 150 amino acids but greater than about 20 amino acids, especially peptides less than about 100 amino acids but greater than about 25 amino acids, especially peptides less than about 65 amino acids but greater than about 25 amino acids, especially peptides less than about 55 amino acids but greater than about 25 amino acids, especially peptides of about 37 or 39 or about 36 to 42 amino acids, especially peptides with less than about 55 amino acids but greater than about 25 amino acids, especially peptides with less than about 45 amino acids but greater than about 35 amino acids, especially peptides with less than about 115 amino acids but greater than about 75 amino acids, especially peptides with less than about 105 amino acids but greater than about 85 amino acids, especially peptides with less than about 100 amino acids but greater than about 90 amino acids, including peptide toxins of any of the lengths mentioned here that can form 2, 3 and or 4 or more intrachain disulphide bridges, including toxins that disrupt calcium channel currents, including toxins that disrupt potassium channel currents, especially insect calcium channels or hybrids thereof, especially toxins or variants thereof of any of these types, and any combination of any of the types of toxins described herein that have topical insecticidal activity, can be made special by the processes described herein.

Venomous peptides from the Australian Funnel Web Spider, genus Atrax and Hadronyche are particularly suitable and work well when treated by the methods, procedures or processes described by this invention. These spider peptides, like many other toxic ICK peptides, including especially are toxic scorpion and toxic plant peptides, become topically active or toxic when treated by the processes described by this invention. Examples of suitable peptides tested and resulting data are provided herein. In addition to the organisms mentioned above, the following species are also specifically know to carry toxins suitable for being made special by the process of this invention. The following species are specifically named: *Agelenopsis aperta, Androctonus australis Hector, Antraxformidabillis, Antrax infensus, Atrax robustus, Bacillus thuringiensis, Bothus martensii Karsch, Bothus occitanus tunetanus, Buthacus arenicola, Buthotus judaicus, Buthus occitanus mardochei, Centruroides noxius, Centruroides suffusus suffusus, Hadronyche infensa, Hadronyche versuta, Hadronyche versutus, Hololena curta, Hottentotta judaica, Leiurus quinquestriatus, Leiurus quinquestriatus hebraeus, Leiurus quinquestriatus quinquestriatus, Oldenlandia affinis, Scorpio maurus palmatus, Tityus serrulatus, Tityus zulianu*. Any peptidic toxins from any of the genus listed above and or genus species are suitable for being made special according to the process in this invention.

The Examples in this specification are not intended to, and should not be used to limit the invention, they are provided only to illustrate the invention.

As noted above, many peptides are suitable candidates as the subject of the process to make special. The sequences noted above, below and in the sequence listing are especially suitable peptides that can be made special, and many of these have been made special according to this invention with the results shown in the examples below.

The Examples in this specification are not intended to, and should not be used to limit the invention, they are provided only to illustrate the invention.

As noted above, many peptides are suitable candidates as the subject of the process for the plant expression as PIP. The sequences noted above, below and in the sequence listing are especially suitable peptides that can be expressed in plants as PEP, and some of these have been expressed in plants as PEP according to this invention with the results shown in the examples below.

(one letter code)
SEQ ID NO: 1042
GSQYC VPVDQ PCSLN TQPCC DDATC TQERN ENGHT VYYCR A.

Named "U+2-ACTX-Hv1a," It has disulfide bridges at positions: 5-20, 12-25, 19-39. The molecular weight is 4564.85 Daltons.

Another example of an ICK motif insecticidal protein is SEQ ID NO: 1010.

(one letter code)
SEQ ID NO: 661
QYCVP VDQPC SLNTQ PCCDD ATCTQ ERNEN GHTVY YCRA

SEQ ID NO: 661, named "Hybrid-ACTX-Hv1a," has disulfide bridges at positions: 3-18, 10-23, 17-37. The molecular weight is 4426.84 Daltons.

(one letter code)
SEQ ID NO: 593
SPTCI PSGQP CPYNE NCCSQ SCTFK ENENGNTVKR CD (three letter code)
SEQ ID NO: 593
Ser Pro Thr Cys Ile Pro Ser Gly Gln Pro Cys Pro Tyr Asn Glu Asn Cys Cys Ser Gln Ser Cys Thr Phe Lys Glu Asn Glu Asn Gly Asn Thr Val Lys Arg Cys Asp Named "ω-ACTX-Hv1a" it has disulfide bridges at positions: 4-18, 11-22 and 17-36. The molecular weight is 4096.

(one letter code)
SEQ ID NO: 650
GSSPT CIPSG QPCPY NENCC SQSCT FKENE NGNTV KRCD (three letter code)
SEQ ID NO: 650
Gly Ser Ser Pro Thr Cys Ile Pro Ser Gly Gln Pro Cys Pro Tyr Asn Glu Asn Cys Cys Ser Gln Ser Cys Thr Phe Lys Glu Asn Glu Asn Gly Asn Thr Val Lys Arg Cys Asp Named "ω-ACTX-Hv1a+2" it has disulfide bridges at positions: 6-20, 13-24 and 19-38. The molecular weight is 4199.

(one letter code)
SEQ ID NO: 651
GSAIC TGADR PCAAC CPCCP GTSCK AESNG VSYCR KDEP (three letter code)
SEQ ID NO: 651
Gly Ser Ala Ile Cys Thr Gly Ala Asp Arg Pro Cys Ala Ala Cys Cys Pro Cys Cys Pro Gly Thr Ser Cys Lys Ala Glu Ser Asn Gly Val Ser Tyr Cys Arg Lys Asp Glu Pro Named "rK-ACTX-Hv1c" it has disulfide bridges at positions: 5-19, 12-24, 15-16, 18-34. The molecular weight is 3912.15

(three letter code)
SEQ ID NO: 652
Gly Ser Gln Tyr Cys Val Pro Val Asp Gln Pro Cys Ser Leu Asn Thr Gln Pro Cys Cys Asp Asp Ala Thr Cys Thr Gln Glu Arg Asn Glu Asn Gly His Thr Val Tyr Tyr Cys Arg Ala Named "rU-ACTX-Hv1a ("Hybrid")+2" it has disulfide bridges at positions: 5-20, 12-25, 19-39. The molecular weight is 4570.51.

Other ICK peptides are provided in the sequence listing. SEQ ID NOs: 534-707 are ICK peptide sequences and include the "kappa"/"omega" toxins and the "hybrid" toxins. SEQ ID NO: 593 is omega-ACTX-Hv1a. SEQ ID NO: 661 is hybrid-ACTX-Hv1a or U-ACTX-Hv1a.

Section II. The TMOF Motif Peptides or TMOF Peptides.

"TMOF motif," or "TMOF proteins" means trypsin modulating oostatic factor peptide. Numerous examples and variants are provided. SEQ ID NO: 708 is the wild type TMOF sequence. Other non-limiting variants are provided in SEQ. ID. NO:s 709-721. Other examples would be known or could be created by one skilled in the art.

Section III. Bt Proteins

Bt are the initials for a bacteria called *Bacillus thuringiensis*. The Bt bacteria produces a family of peptides that are toxic to many insects. The Bt toxic peptides are well known for their ability to produce parasporal crystalline protein inclusions (usually referred to as crystals) that fall under two major classes of toxins; cytolysins (Cyt) and crystal Bt proteins (Cry). Since the cloning and sequencing of the first crystal proteins genes in the early-1980s, may others have been characterized and are now classified according to the nomenclature of Crickmore et al. (1998). Generally Cyt proteins are toxic towards the insect orders Coleoptera (beetles) and Diptera (flies), and Cry proteins target Lepidopterans (moths and butterflies). Cry proteins bind to specific receptors on the membranes of mid-gut (epithelial) cells resulting in rupture of those cells. If a Cry protein cannot find a specific receptor on the epithelial cell to which it can bind, then it is not toxic. Bt strains can have different complements of Cyt and Cry proteins, thus defining their host ranges. The genes encoding many Cry proteins have been identified.

Currently there are four main pathotypes of insecticidal Bt parasporal peptides based on order specificity: Lepidotera-specific (CryI, now Cry1), Coleoptera-specific (CryIII, now Cry3), Diptera-specific (CryIV, now Cry4, Cry 10, Cry11; and CytA, now Cyt1A), and CryII (Now Cry2), the only family known at that time to have dual (Lepidoptera and Diptera) specificity. Cross-order activity is now apparent in many cases.

The nomenclature assigns holotype sequences a unique name which incorporates ranks based on the degree of divergence, with the boundaries between the primary (Arabic numeral), secondary (uppercase letter), and tertiary (lower case letter) rank representing approximately 95%, 78% and 45% identities. A fourth rank (another Arabic number) is used to indicate independent isolations of holotype toxin genes with sequences that are identical or differ only slightly. Currently, the nomenclature distinguishes 174 holotype sequences that are grouping in 55 cry and 2 cyt families (Crickmore, N., Zeigler, D. R., Schnepf, E., Van Rie, J., Lereclus, D., Daum, J, Bravo, A., Dean, D. H., *B. thuringiensis* toxin nomenclature). Any of these crystal proteins and the genes that produce them may be used to produce a suitable Bt related toxin for this invention.

Also included in the descriptions of this invention are families of highly related crystal proteins produced by other bacteria: Cry16 and Cry17 from Clostridium bifermentans (Barloy et al., 1996, 1998), Cry 18 from *Bacillus popilliae* (Zhang et al., 1997), Cry43 from *Paenibacillus lentimorbis* (Yokoyama et al., 2004) and the binary Cry48/Cry49 produced by *Bacillus* sphaericus (Jones et al., 2008). Other crystalline or secreted pesticidal proteins, such as the S-layer proteins (Peña et al., 2006) that are included here are, genetically altered crystal proteins, except those that were modified through single amino acid substitutions (e.g., Lambert et al., 1996). Any of these genes may be used to produce a suitable Bt related toxin for this invention.
Examples of Bt In particular, isolated nucleic acid molecules corresponding to Bt protein nucleic acid sequences are provided. Additionally, amino acid sequences corresponding to the polynucleotides are encompassed. In particular, the present invention provides for an isolated nucleic acid molecule comprising a nucleotide sequence encoding the amino acid sequence shown in US 2009/0099081, published on Apr. 18, 2009, all of which is herein incorporated by reference in its entirety, and all sequences identified by number specifically incorporated by reference. SEQ ID NO: 9, 11, 13, 15, or 18, or a nucleotide sequence set forth in SEQ ID NO: 1, 2, 4, 6, 7, 8, 10, 12, 14, 16, or 17, as well as variants and fragments thereof. Nucleotide sequences that are complementary to a nucleotide sequence of the invention, or that hybridize to a sequence of the invention are also encompassed.

Nucleotide sequences encoding the proteins of the present invention include the sequence set forth in US 2009/0099081, published on Apr. 18, 2009, SEQ ID NO: 1, 2, 4, 6, 7, 8, 10, 12, 14, 16, or 17, and variants, fragments, and complements thereof. By "complement" is intended a nucleotide sequence that is sufficiently complementary to a given nucleotide sequence such that it can hybridize to the given nucleotide sequence to thereby form a stable duplex. The corresponding amino acid sequence for the Bt protein encoded by this nucleotide sequence are set forth in SEQ ID NO: 33-533.

Nucleic acid molecules that are fragments of these Bt protein encoding nucleotide sequences are also encompassed by the present invention (for example, US 2009/0099081, published on Apr. 18, 2009, all of which is herein incorporated by reference in its entirety, and all sequences identified by number specifically incorporated by reference. SEQ ID NO: 8 is a fragment of SEQ ID NO: 4 and 12; SEQ ID NO: 4 is a fragment of SEQ ID NO: 2). By "fragment" is intended a portion of the nucleotide sequence encoding a Bt protein. A fragment of a nucleotide sequence may encode a biologically active portion of a Bt protein, or it may be a fragment that can be used as a hybridization probe or PCR primer using methods disclosed below. Nucleic acid molecules that are fragments of a Bt protein nucleotide sequence comprise at least about 50, 100, 200, 300, 400, 500, 600, 700, 800, 900, 1000, 1050, 1100, 1150, 1200, 1250, 1300, 1350, 1400, 1450, 1500, 1550, 1600, 1650, 1700, 1750, 1800, 1850, 1860, 1870, 1880, 1885 contiguous nucleotides, or up to the number of nucleotides present in a full-length Bt-protein encoding nucleotide sequence disclosed herein (for example, 1890 nucleotides for US 2009/0099081, published on Apr. 18, 2009, Here these are provided as SEQ ID NO: 1 and 2, 1806 nucleotides for SEQ ID NO: 4, 1743 nucleotides for SEQ ID NO: 6, 7, 8, and 16, 1809 nucleotides for SEQ ID NO: 10, and 1752 nucleotides for SEQ ID NO: 12 and 14, in the sequence listing) depending upon the intended use. By "contiguous" nucleotides is intended nucleotide residues that are immediately adjacent to one another. Fragments of the nucleotide sequences of the present invention will encode protein fragments that retain the biological activity of the Bt protein protein and, hence, retain pesticidal activity. By "retains activity" is intended that the fragment will have at least about 30%, at least about 50%, at least about 70%, 80%, 90%, 95% or higher of the pesticidal activity of the Bt protein. Methods for measuring pesticidal activity are well known in the art. See, for example, Czapla and Lang (1990) J. Econ. Entomol. 83:2480-2485; Andrews et al. (1988) Biochem. J. 252:199-206; Marrone et al. (1985) J. of Economic Entomology 78:290-293; and U.S. Pat. No. 5,743,477, all of which are herein incorporated by reference in its entirety, and all sequences identified by number specifically incorporated by reference.

A fragment of a Bt protein encoding nucleotide sequence that encodes a biologically active portion of a protein of the invention will encode at least about 15, 25, 30, 50, 75, 100, 125, 150, 175, 200, 250, 300, 350, 400, 450, 500, 550, 560, 570, 575, 580, 585, 590, 595, 600 contiguous amino acids, or up to the total number of amino acids present in a full-length Bt protein protein of the invention (for example, 580 amino acids for SEQ ID NO: 41, 602 amino acids for SEQ ID NO: 43, and 583 amino acids for SEQ ID NO: 45 and 47).

Preferred Bt protein proteins of the present invention are encoded by a nucleotide sequence sufficiently identical to the nucleotide sequence of US 2009/0099081, published on Apr. 18, 2009, all of which is herein incorporated by reference in its entirety, and all sequences identified by number specifically incorporated by reference, sequences 1, 2, 4, 6, 7, 8, 10, 12, 14, 16, or 17. By "sufficiently identical" is intended an amino acid or nucleotide sequence that has at least about 60% or 65% sequence identity, about 70% or 75% sequence identity, about 80% or 85% sequence identity, about 90%, 91%, 92%, 93%, 94%, 95%, 96%, 97%, 98%, 99% or greater sequence identity compared to a reference sequence using one of the alignment programs described herein using standard parameters. One of skill in the art will recognize that these values can be appropriately adjusted to determine corresponding identity of proteins encoded by two nucleotide sequences by taking into account codon degeneracy, amino acid similarity, reading frame positioning, and the like.

The invention also encompasses variant nucleic acid molecules (for example, US 2009/0099081, published on Apr. 18, 2009, all of which is herein incorporated by reference in its entirety, and all sequences identified by number specifically incorporated by reference, sequence 2 is a variant of sequences 1; sequence 7 and 8 are variants of sequences 6; sequence 10 is a variant of sequence 4 and 12; and sequence 14 is a variant of sequence 12). "Variants" of the Bt protein encoding nucleotide sequences include those sequences that encode the Bt protein disclosed herein but that differ conservatively because of the degeneracy of the genetic code as well as those that are sufficiently identical as discussed above.

Naturally occurring allelic variants can be identified with the use of well-known molecular biology techniques, such as polymerase chain reaction (PCR) and hybridization techniques as outlined below. Variant nucleotide sequences also include synthetically derived nucleotide sequences that have been generated, for example, by using site-directed mutagenesis but which still encode the Bt protein proteins disclosed in the present invention as discussed below. Variant proteins encompassed by the present invention are biologically active, that is they continue to possess the desired biological activity of the native protein, that is, retaining pesticidal activity. By "retains activity" is intended that the variant will have at least about 30%, at least about 50%, at least about 70%, or at least about 80% of the pesticidal activity of the native protein. Methods for measuring pesticidal activity are well known in the art. See, for example, Czapla and Lang (1990) J. Econ. Entomol. 83: 2480-2485; Andrews et al. (1988) Biochem. J. 252:199-206; Marrone et al. (1985) J. of Economic Entomology 78:290-293; and U.S. Pat. No. 5,743,477, all of which are herein incorporated by reference in their entirety, and all sequences identified by number specifically incorporated by reference.

Examples of the Generation of Synthetic and Variant Bt Genes

In one aspect of the invention, synthetic axmi-004 sequences were generated, for example synaxmi-004 US 2009/0099081, published on Apr. 18, 2009, all of which is herein incorporated by reference in its entirety, and all sequences identified by number specifically incorporated by reference, (sequence 1) and synaxmi-004B (sequence 2). These synthetic sequences have an altered DNA sequence relative to the axmi-004 sequence (sequence 3) recited in U.S. Pat. No. 7,355,099, all of which is herein incorporated by reference in its entirety, and all sequences identified by number specifically incorporated by reference), and encode the original AXMI-004 protein. Likewise, synaxmi-004B-2M (sequence 4) was designated and encodes the axmi-004 alternate start site (herein referred to as axmi-004B-2M and set forth in sequence 5) originally identified in U.S. patent application Ser. No. 10/782,020.

In another aspect of the invention, a third start site was identified in the axmi-004 coding sequence. This coding region is designated axmi-004B-3M (US 2009/0099081, published on Apr. 18, 2009, all of which is herein incorporated by reference in its entirety, and all sequences identified by number specifically incorporated by reference, sequence 16) and encodes the AXMI-004B-3M amino acid sequence set forth in sequence 9. Synthetic sequences encoding the AXMI-004B-3M protein were also designated. These synthetic nucleotide sequences were designated synaxmi-004B-3M, synaxmi-004C-3M, and synaxmi-004D-3M and are set forth in sequences 6, 7, and 8, respectively. In another aspect of the invention, modified versions of the nucleotide sequence encoding AXMI-004B-3M protein were designed such that additional N-terminal residues are added to the encoded protein. These sequence are designated synaxmi-004B-3M-alt1 (US 2009/0099081, published on Apr. 18, 2009, sequence 10), synaxmi-004B-3M-alt2 (sequence 12), synaxmi-004B-3M-alt3 (sequence 14), and synaxmi-004B-3M-alt4 (sequence 17). The encoded proteins are designated AXMI-004B-3M-ALT1 (sequence 11), AXMI-004B-3M-ALT2 (sequence 13), AXMI-004B-3M-ALT3 (sequence 15), and AXMI-004B-3M-ALT4 (sequence 18).

Other Bt proteins and gene descriptions can be found in the following. Each and every patent publication referred to below with a note as to the Bt toxin to which the publication refers to, is hereby incorporated by reference in its entirely. These documents have also published and they and their sequences are in the public domain.

More Examples of Bt genes, proteins, and the patent documents that describe them are found in Tables 4, 5, and 6 below. The patent documents in Tables 4, 5, 6, in particular the US Patents and US applications, are hereby incorporated by reference in their entirety.

TABLE 4

| Bt Toxins | |
|---|---|
| Toxin | Patents or patent publication No. |
| Cry1 | U.S. 2003046726, U.S. Pat. No. 6,833,449, CN1260397, U.S. 201026939, U.S. 2006174372, U.S. 2006174372, U.S. 642241, U.S. Pat. No. 6,229,004, U.S. 2004194165, U.S. Pat. No. 6,573,240, U.S. Pat. No. 5,424,409, U.S. Pat. No. 5,407,825, U.S. Pat. No. 5,135,867, U.S. Pat. No. 5,055,294, |
| Cry1 | WO2007107302, U.S. Pat. No. 6,855,873, WO2004020636, U.S. 2007061919, U.S. Pat. No. 6,048,839, U.S. 2007061919, AU784649B, U.S. 2007061919, U.S. Pat. No. 6,150,589, U.S. Pat. No. 5,679,343, U.S. Pat. No. 5,616,319, U.S. Pat. No. 5,322,687, |
| Cry1 | WO2007107302, U.S. 2006174372, U.S. 2005091714, U.S. 2004058860, U.S. 2008020968, U.S. Pat. No. 6,043,415, U.S. Pat. No. 5,942,664, |
| Cry1 | WO2007107302, U.S. 2007061919, U.S. Pat. No. 6,172,281, |
| Cry1 | WO03082910, MX9606262, U.S. Pat. No. 5,530,195, U.S. Pat. No. 5,407,825, U.S. Pat. No. 5,045,469, |
| Cry1 | U.S. 2006174372, |
| Cry1 | U.S. 2007061919, |
| Cry1 | U.S. 2007061919, |
| Cry1 | U.S. 2007061919, CN1401772, U.S. Pat. No. 6,063,605, |
| Cry1 | U.S. 2007061919, AU784649B, U.S. Pat. No. 5,723,758, U.S. Pat. No. 5,616,319, U.S. Pat. No. 5,356,623, U.S. Pat. No. 5,322,687 |
| Cry1 | U.S. Pat. No. 5,723,758 |
| Cry2 | CN1942582, WO9840490, U.S. 2007061919, UA75570, MXPA03006130, U.S. 2003167517, U.S. Pat. No. 6,107,278, U.S. Pat. No. 6,096,708, U.S. Pat. No. 5,073,632, U.S. Pat. No. 7,208,474, U.S. Pat. No. 7,244,880, |
| Cry3 | U.S. 2002152496, RU2278161, U.S. 2003054391, |
| Cry3 | U.S. Pat. No. 5,837,237, U.S. Pat. No. 5,723,756, U.S. Pat. No. 5,683,691, U.S. Pat. No. 5,104,974, U.S. Pat. No. 4,996,155, |
| Cry3 | U.S. Pat. No. 5,837,237, U.S. Pat. No. 5,723,756, |
| Cry5 | WO9840491, U.S. 2004018982, U.S. Pat. No. 6,166,195, U.S. 2001010932, U.S. Pat. No. 5,985,831, U.S. Pat. No. 5,824,792, U.S. 528153 |
| Cry5 | WO2007062064, U.S. 2001010932, U.S. Pat. No. 5,824,792, |
| Cry6 | WO2007062064, U.S. 2004018982, U.S. Pat. No. 5,973,231, U.S. Pat. No. 5,874,288, U.S. Pat. No. 5,236,843, U.S. 683106 |
| Cry6 | U.S. 2004018982, U.S. Pat. No. 6,166,195, |
| Cry7 | U.S. Pat. No. 6,048,839, U.S. Pat. No. 5,683,691, U.S. Pat. No. 5,378,625, U.S. 518709 |
| Cry7 | CN195215 |
| Cry8 | |
| Cry8 | |

TABLE 4-continued Bt Toxins

| Toxin | Patents or patent publication No. |
|---|---|
| Cry8 | U.S. 200301796 |
| Cry8 | WO2006053473, U.S. 2007245430, |
| Cry8 | WO200605347 |
| Cry9 | U.S. 2007061919, |
| Cry9 | WO200506620 |
| Cry9 | U.S. 2007061919, U.S. Pat. No. 6,448,226, U.S. 2005097635, WO2005066202, U.S. Pat. No. 6,143,550, U.S. Pat. No. 6,028,246, U.S. Pat. No. 6,727,409, |
| Cry9 | U.S. 2005097635, WO2005066202, |
| Cry9 | U.S. Pat. No. 6,570,005, |
| Cry9 | AU784649B, U.S. 2007074308, U.S. 736180 |
| Cry11 | MXPA0200870 |
| Cry12 | U.S. 2004018982, U.S. Pat. No. 6,166,195, U.S. Pat. No. 6,077,937, U.S. Pat. No. 5,824,792, U.S. Pat. No. 5,753,492, |
| Cry13 | U.S. 2004018982, U.S. 6,166,195, U.S. Pat. No. 6,077,937, U.S. Pat. No. 5,824,792, U.S. Pat. No. 5,753,492, |
| Cry14 | JP2007006895, U.S. Pat. No. 5,831,011, |
| Cry21 | U.S. Pat. No. 5,831,011, U.S. Pat. No. 5,670,365, |
| Cry22 | U.S. 2006218666, U.S. 2001010932, MXPA01004361, U.S. Pat. No. 5,824,792, |
| Cry22 | U.S. 2003229919, |
| Cry23 | U.S. 2006051822, U.S. 2003144192, UA75317, U.S. Pat. No. 6,399,330, U.S. Pat. No. 6,326,351, U.S. Pat. No. 6,949,626, |
| Cry26 | U.S. 200315001 |
| Cry28 | U.S. 200315001 |
| Cry31 | CA2410153, |
| Cry34 | U.S. 200316752 |
| Cry35 | U.S. 2003167522, |
| Cry37 | U.S. 2006051822, U.S. 2003144192, UA75317, U.S. 6,399,330, U.S. 6,326,351, U.S. Pat. No. 6,949,626, |
| Cry43 | U.S. 200527164 |
| Cyt1 | WO2007027776, |
| Cyt1 | U.S. 6150165, |
| Cyt2 | U.S. 2007163000, EP1681351, U.S. Pat. No. 6,686,452, U.S. Pat. No. 6,537,756, |

TABLE 5

Hybrid Insecticidal Crystal Proteins and Patents.

| Patents[a] | Holotype Toxin[b] |
|---|---|
| U.S. 2008020967 | Cry29Aa |
| U.S. 2008040827 | Cry1Ca |
| U.S. 2007245430 | Cry8Aa |
| U.S. 2008016596 | Cry8Aa |
| U.S. 2008020968 | Cry1Cb |

TABLE 6

Patents Relating to Other Hybrid Insecticidal Crystal Proteins

| Source toxins[a] | Patents[b] |
|---|---|
| Cry1A, Cry1C | U.S. Pat. No. 5,593,881, U.S. Pat. No. 5,932,209 |
| Cry1C, Cry1A, Cry1F | U.S. Pat. No. 6,962,705, U.S. Pat. No. 7,250,501, U.S. 2004093637, WO0114562, WO0214517, U.S. Pat. No. 6,156,573 |
| Cry23A, Cry37A | U.S. Pat. No. 7,214,788 |
| Cry1A | U.S. Pat. No. 7,019,197 |
| Cry1A, Cry1B | U.S. Pat. No. 6,320,100 |
| Cry1A, Cry1C | AU2001285900B |
| Cry23A, Cry37A | U.S. 2007208168 |
| Cry3A, Cry1I, Cry1B | WO0134811 |

TABLE 6-continued

Patents Relating to Other Hybrid Insecticidal Crystal Proteins

| Source toxins[a] | Patents[b] |
|---|---|
| Cry3A, Cry3B, Cry3C | U.S. 2004033523 |
| Cry1A, Cry1C, Cry1E | U.S. Pat. No. 6,780,408 |
| Cry1G | |
| Cry1A, Cry1F | U.S. 2008047034 |

The sequence listing includes Bt sequences SEQ. ID. NO:s 33-533. These sequences include examples of Bt protein Cry and Cyt protein sequences. Examples are numerous and one skilled in the art would know of many other examples of various Bt sequences that are suitable substitutes for those in this disclosure.

Section IV. Pesticide Compositions and Increasing Plant Yields

The active ingredients of the present invention are normally applied in the form of compositions and can be applied to the crop area or plant to be treated, simultaneously or in succession, with other compounds. These compounds can be fertilizers, weed killers, cryoprotectants, surfactants, detergents, pesticidal soaps, dormant oils, polymers, and/or time-release or biodegradable carrier formulations that permit long-term dosing of a target area following a single application of the formulation. They can also be selective herbicides, chemical insecticides, virucides, microbicides, amoebicides, pesticides, fungicides, bacteriocides, nematocides, molluscicides or mixtures of several of these preparations, if desired, together with further agriculturally acceptable carriers, surfactants or application-promoting adjuvants customarily employed in the art of formulation. Suitable carriers and adjuvants can be solid or liquid and correspond to the substances ordinarily employed in formulation technology, e.g. natural or regenerated mineral substances, solvents, dispersants, wetting agents, tackifiers, binders or fertilizers. Likewise the formulations may be prepared into edible "baits" or fashioned into pest "traps" to permit feeding or ingestion by a target pest of the pesticidal formulation.

Methods of applying an active ingredient of the present invention or an agrochemical composition of the present invention that contains at least one of the pesticidal proteins produced by the bacterial strains of the present invention include leaf application, seed coating and soil application. The number of applications and the rate of application depend on the intensity of infestation by the corresponding pest.

The composition may be formulated as a powder, dust, pellet, granule, spray, emulsion, colloid, solution, or such like, and may be prepared by such conventional means as desiccation, lyophilization, homogenation, extraction, filtration, centrifugation, sedimentation, or concentration of a culture of cells comprising the polypeptide. In all such compositions that contain at least one such pesticidal polypeptide, the polypeptide may be present in a concentration of from about 1% to about 99% by weight.

Lepidopteran or coleopteran pests may be killed or reduced in numbers in a given area by the methods of the invention, or may be prophylactically applied to an environmental area to prevent infestation by a susceptible pest. Preferably the pest ingests, or is contacted with, a pesticidally-effective amount of the polypeptide. By "pesticidally-effective amount" is intended an amount of the pesticide that is able to bring about death to at least one pest, or to noticeably reduce pest growth, feeding, or normal physiological development. This amount will vary depending on such factors as, for example, the specific target pests to be controlled, the specific environment, location, plant, crop, or agricultural site to be treated, the environmental conditions, and the method, rate, concentration, stability, and quantity of application of the pesticidally-effective polypeptide composition. The formulations may also vary with respect to climatic conditions, environmental considerations, and/or frequency of application and/or severity of pest infestation.

The pesticide compositions described may be made by formulating either the bacterial cell, crystal and/or spore suspension, or isolated protein component with the desired agriculturally-acceptable carrier. The compositions may be formulated prior to administration in an appropriate means such as lyophilized, freeze-dried, desiccated, or in an aqueous carrier, medium or suitable diluent, such as saline or other buffer. The formulated compositions may be in the form of a dust or granular material, or a suspension in oil (vegetable or mineral), or water or oil/water emulsions, or as a wettable powder, or in combination with any other carrier material suitable for agricultural application. Suitable agricultural carriers can be solid or liquid and are well known in the art. The term "agriculturally-acceptable carrier" covers all adjuvants, inert components, dispersants, surfactants, tackifiers, binders, etc. that are ordinarily used in pesticide formulation technology; these are well known to those skilled in pesticide formulation. The formulations may be mixed with one or more solid or liquid adjuvants and prepared by various means, e.g., by homogeneously mixing, blending and/or grinding the pesticidal composition with suitable adjuvants using conventional formulation techniques. Suitable formulations and application methods are described in U.S. Pat. No. 6,468,523, herein incorporated by reference.

Methods for Increasing Plant Yield

Methods for increasing plant yield are provided. The methods comprise introducing into a plant or plant cell a polynucleotide comprising a pesticidal sequence disclosed herein. As defined herein, the "yield" of the plant refers to the quality and/or quantity of biomass produced by the plant. By "biomass" is intended any measured plant product. An increase in biomass production is any improvement in the yield of the measured plant product. Increasing plant yield has several commercial applications. For example, increasing plant leaf biomass may increase the yield of leafy vegetables for human or animal consumption. Additionally, increasing leaf biomass can be used to increase production of plant-derived pharmaceutical or industrial products. An increase in yield can comprise any statistically significant increase including, but not limited to, at least a 1% increase, at least a 3% increase, at least a 5% increase, at least a 10% increase, at least a 20% increase, at least a 30%, at least a 50%, at least a 70%, at least a 100% or a greater increase in yield compared to a plant not expressing the pesticidal sequence.

In specific methods, plant yield is increased as a result of improved pest resistance of a plant expressing a pesticidal protein disclosed herein. Expression of the pesticidal protein results in a reduced ability of a pest to infest or feed on the plant, thus improving plant yield.

Section V. Plant Transformations

Any combination of the principal components ICK motif protein and or TMOF motif protein and Bt protein, can be combined in a PIP. We also disclose the addition of ERSP (Endoplasmic Reticulum Signal Peptide) and a translational stabilizing protein and intervening linker in order to create a superior PIP (Plant-incorporated protectant) and expressed as a PEP (Plant Expressed Peptide) as long as a minimum of both Bt and ICK motif protein are used, it is preferred to use these two peptides in combination with ERSP. TMOF motif can also be used with or replacing the ICK motif. These compositions can be created, used as a PEP and expressed as a PIP.

We describe methods to increase the efficacy of the plant expression, to increase the accumulation of plant expressed proteins and to dramatically increase the insecticidal activity of plant expressed proteins. We describe targeting of the ICK motif protein to the Endoplasmic Reticulum (ER) by an Endoplasmic Reticulum Signaling Protein (ERSP) in plants, in order to provide for the correct covalent cross-linking of peptide disulfide bridges which generate the essential tertiary ICK motif structure required for insecticidal activity. We further describe targeting of the ICK motif protein to the ER by an ERSP in plants, with a translational stabilizing protein domain added in order to increase the size of the resulting ICK fusion protein which enhances peptide accumulation in the plant. We further describe targeting of the ICK motif protein to the ER by an ERSP in plants, with a translation stabilizing protein added as above, and with an intervening peptide sequence added, the latter of which allows for potential cleavage and the recovery of the active form of the ICK motif protein having insecticidal activity.

This invention describes the ICK motif proteins with insecticidal activity that are plant expressed and which can successfully protect a plant or crop from insect damage. The methods taught herein will enable peptides to not only be expressed in a plant but to be expressed and folded properly, so that they retain their insecticidal activity even after expression in the plant.

We describe how the open reading frame (ORF) of a target peptide, such as an ICK motif peptide, must be modified in order for the desired biological activity to remain after plant expression of the ICK motif peptide. In one embodiment we describe a Plant Incorporated Protectant, or PIP, that expresses an active insecticidal protein. The PIP insecticidal protein is comprised of an Endoplasmic Reticulum Signal Peptide (ERSP) operably linked to a Cysteine Rich Insecticidal Peptide (CRIP) or Inhibitor Cystine Knot (ICK) motif protein, wherein the ERSP is the N-terminal of the linked ERSP+ICK motif protein. The PIP insecticidal protein is then incorporated into a plant of choice to give insect resistance to the plant. The plant cells will express and accumulate the properly folded ICK motif insecticidal protein. When an insect consumes the plant cells, the properly folded ICK motif insecticidal protein will be delivered inside the insect where it will have insecticidal activity and cause the insect either to slow or to stop its feeding, slow its movements, and slow or stop reproduction, all of which provides protection for the plant from insect damage.

We describe transient expression systems to express various plant expression cassettes. One expressed transgene we use is Green Fluorescent Protein or GFP, which is detectable visually when excited by UV light. The GFP transient expression system we used for the evaluation of plant transgenic proteins is for all practical purposes-equivalent to use of a stable transgenic plant system for these types of evaluations.

The CRIP, ICK, TMOF, Sea Anemone Motif can be Linked to the ERSP.

For the ICK motif insecticidal protein to be properly folded when it is expressed from a transgenic plant, it must have an ERSP fused in frame with the ICK motif insecticidal protein. This can also be done with a TMOF motif. This can be accomplished in several ways. See FIGS. 1, 2 and 3. The protein should be routed through the ER where the correct covalent bond connections for proper disulfide bond formation are formed. Without wishing to be bound by theory, we believe the ER routing results in the correct tertiary structure of the ICK motif protein. It is commonly postulated that such routing is achieved by a cellular component called a signal-recognition particle: the signal-recognition particle binds to the ribosome translating the protein, it pauses translation, and it transports the ribosome/mRNA complex to a translocator pore in the ER, where the ribosome then continues the translation and threads the resulting protein into the ER. Within the ER the ERSP is cleaved and the protein is acted upon by posttranslational modification processes in the ER. Once such process involves protein disulfide isomerases, a class of proteins that catalyse the formation of disulfide bonds. Without any additional retention protein signals, the protein is transported through the ER to the golgi apparatus, where it is finally secreted outside the plasma membrane and into the apoplastic space. Without wishing to be bound by theory, we think proteins, such as insecticidal proteins, that have an ICK motif, need to be routed through the ER, in order for the proteins to have correct disulfide bond formation, if they are expressed in plants.

The ERSP (Endoplasmic Reticulum Signaling Protein).

In addition to the text below, see Part I-1 (The EERSP or ersp component of the PEPs.

The ERSP is the N-terminal region of the ERSP+ICK motif protein complex and the ERSP portion is composed of about 3 to 60 amino acids. In some embodiments it is 5 to 50 amino acids. In some embodiments it is 10 to 40 amino acids but most often is composed of 15 to 20; 20 to 25; or 25 to 30 amino acids. The ERSP is a signal peptide so called because it directs the transport of a protein. Signal peptides may also be called targeting signals, signal sequences, transit peptides, or localization signals. The signal peptides for ER targeting are often 15 to 30 amino acid residues in length and have a tripartite organization, comprised of a core of hydrophobic residues flanked by a positively charged aminoterminal and a polar, but uncharged carboxyterminal region. See: Zimmermann, Richard; Eyrisch, Susanne; Ahmad, Mazen and Helms, Volkhard: "Protein translocation across the ER membrane" *Biochimica et Biohysica Acta* 1808 (2011) 912-924, Elsevier.

About half and often more of the ERSP is usually comprised of hydrophobic amino acids, but the percentage of amino acids in an ERSP that are hydrophobic can vary. Without wishing to be bound by any theory of how the invention works, we think the hydrophobic amino acids stick in the membrane of the ER after translation and this allows the signal peptide peptidase to cleave the ERSP off of the translated protein, releasing the ICK motif protein into the ER. Many ERSPs are known. Many plant ERSPs are known. It is NOT required that the ERSP be derived from a plant ERSP, non-plant ERSPs will work with the procedures described herein. Many plant ERSPs are however well known and we describe some plant derived ERSPs here. BAAS, for example, is derived from the plant, *Hordeum vulgare*.

One example of a ERSP used here is BAAS, the sequence of BAAS is MANKH LSLSL FLVLL GLSAS LASG (SEQ ID NO: 1035—one letter code).

Figure 2:
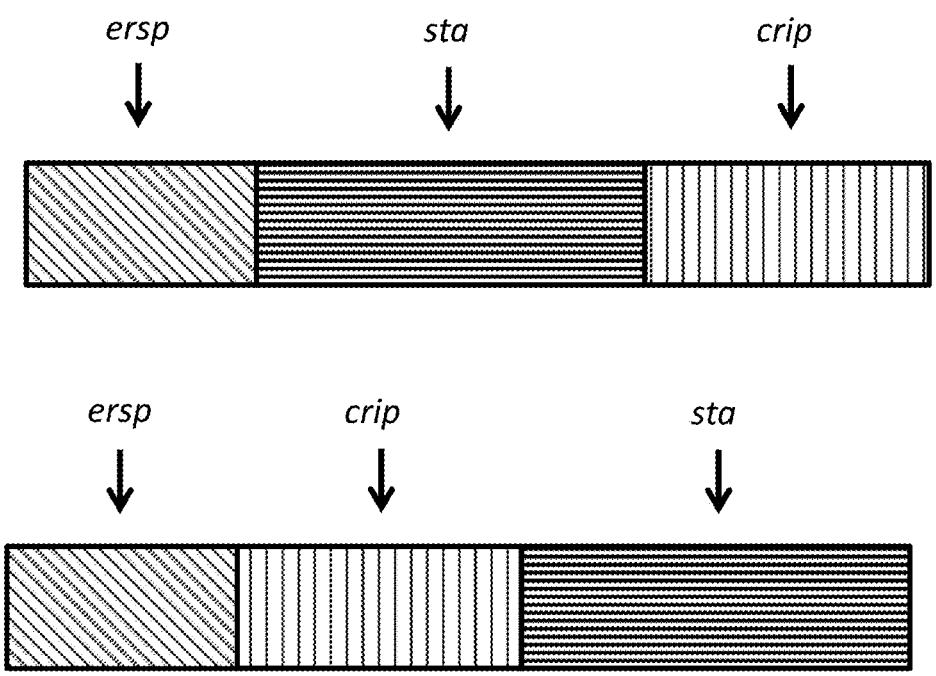
FIG. 2 is a diagram of invention of N-terminal fusion of ERSP (diagonal stripes) to a CRIP motif insecticidal protein (vertical stripes) that is fused with a STA (Translational Stabilizing Protein in horizontal stripes). There are two possible orientations shown in FIG. 2.

This peptide, named "BAAS" is cleaved from the ICK motif upon the protein's translation into the ER. The molecular weight is 2442.94 Daltons. FIGS. 1-3 shows a representation of an ICK motif protein linked to an ERSP. These figures could equally represent a TMOF motif protein linked to an ERSP.

Plant ERSPs, which are selected from the genomic sequence for proteins that are known to be expressed and released into the apoplastic space of plants, and a few examples are BAAS, carrot extensin, tobacco PR1. The following references provide further descriptions, and are incorporated by reference herein in their entirety. De Loose, M. et al. "The extension signal peptide allows secretion of a heterologous protein from protoplasts" Gene, 99 (1991) 95-100. De Loose, M. et al. described the structural analysis of an extensin-encoding gene from *Nicotiana plumbaginifolia*, the sequence of which contains a typical signal peptide for translocation of the protein to the endoplasmic reticulum. Chen, M. H. et al. "Signal peptide-dependent targeting of a rice alpha-amylase and cargo proteins to plastids and extracellular compartments of plant cells" *Plant Physiology*, 2004 July; 135(3): 1367-77. Epub 2004 Jul. 2. Chen, M. H. et al. studied the subcellular localization of α-amylases in plant cells by analyzing the expression of α-amylase, with and without its signal peptide, in transgenic tobacco. These references and others teach and disclose translational stabilizing proteins that can be used in the methods, procedures and peptide, protein and nucleotide complexes and constructs described herein.

The Translational Stabilizing Protein.

In addition to the text below, see Part I-III (The translational stabilizing protein component, STA or sta.

The procedures described above refer to providing a ERSP+CRIP where ERSP+CRIP could be ERSP+ICK, ERSP+Non-ICK, ERSP+Av (SEA ANOMONE) or the procedures could refer to ERSP+TMOF, or they could refer to ERSP+CRIP and a TMOF sufficient to make a plant produce properly folded peptides. We also suggest that in order to more fully protect a plant from some insects, more than just proper folding is sometimes needed. With a properly constructed expression cassette, a plant can be induced to make and accumulate even greater amounts of toxic peptide. When a plant accumulates greater amounts of properly folded toxic CRIP or TMOF peptides it can more easily resist or kill the insects that attack and eat the plants. One way to increase the insecticidal activity of the PIP is with translational stabilizing proteins. The translational stabilizing protein can be used to significantly increase the accumulation of the toxic peptide in the plant and thus the potency of the PIP, especially when the PIP has a translational stabilizing protein of its own. The procedures described herein can provide for the accumulation in the plant of large amounts of the now properly folded transgenic plant proteins. Transgenic plants expressing both an ICK motif insecticidal protein and a translational stabilizing protein, demonstrate dramatically improved accumulation of toxic ICK peptides over systems without a translational stabilizing protein. Representative PIPs with a translational stabilizing protein are described herein.

Experiments comparing plant expressed peptides both with and without a translational stabilizing protein show dramatic differences. The protein expression of an ICK-motif protein without a translational stabilizing protein can be very low. When a translational stabilizing protein is fused to the ICK-motif protein, there are higher levels of detectable accumulation. The translational stabilizing protein can be a domain of another protein or it can comprise an entire protein sequence. The translational stabilizing protein is a protein with sufficient tertiary structure that it can accumulate in a cell without being targeted by the cellular process of protein degradation. The protein can be between 5 and 50aa (eg another ICK-motif protein), 50 to 250aa (GNA), 250 to 750aa (eg chitinase) and 750 to 1500aa (eg enhancin).

The translational stabilizing protein, (or protein domain) can contain proteins that have no useful characteristics other than translation stabilization, or they can have other useful traits in addition to translational stabilization. One embodiment of the translation stabilization protein can be multiple ICK-motif proteins in tandem. Useful traits can include: additional insecticidal activity, such as activity that is destructive to the peritrophic membrane, activity that is destructive to the gut wall, and/or activity that actively transports the ICK motif protein across the gut wall. One embodiment of the translational stabilizing protein can be a polymer of fusions proteins involving ICK motif proteins. One embodiment of the translational stabilizing protein can be a polymer of fusions proteins involving TMOF motif proteins. A specific example of a translational stabilizing protein is provided here to illustrate the use of a translational stabilizing protein. The example is not intended to limit the disclosure or claims in any way. Useful translational stabilizing proteins are well known in the art, and any proteins of this type could be used as disclosed herein. Procedures for evaluating and testing production of peptides are both known in the art and described herein. One example of one translational stabilizing protein is SEQ ID NO:1036, one letter code, as follows:

```
(one letter code)
                                           SEQ ID NO: 1036
ASKGE ELFTG VVPIL VELDG DVNGH KFSVS GEGEG DATYG

KLTLK FICTT GKLPV PWPTL VTTFS YGVQC FSRYP DHMKR

HDFFK SAMPE GYVQE RTISF KDDGN YKTRA EVKFE GDTLV

NRIEL KGIDF KEDGN ILGHK LEYNY NSHNV YITAD KQKNG

IKANF KIRHN IEDGS VQLAD HYQQN TPIGD GPVLL PDNHY

LSTQS ALSKD PNEKR DHMVL LEFVT AAGIT HGMDE LYK.
```

Seq. ID No. 1036 is Named "GFP". The molecular weight is 26736.02 Daltons.

Additional examples of translational stabilizing proteins proteins can be found in the following references, incorporated by reference in their entirety: Kramer, K. J. et al. "Sequence of a cDNA and expression of the gene encoding epidermal and gut chitinases of Manduca sexta" *Insect Biochemistry and Molecular Biology*, Vol. 23, Issue 6, September 1993, pp. 691-701. Kramer, K. J. et al. isolated and sequenced a chitinase-encoding cDNA from the tobacco hornworm, *Manduca sexta*. Hashimoto, Y. et al. "Location and nucleotide sequence of the gene encoding the viral enhancing factor of the *Trichoplusia ni* granulosis virus" *Journal of General Virology*, (1991), 72, 2645-2651. Hashimoto, Y. et al. cloned the gene encoding the viral enhancing factor of a *Trichoplusia ni* granulosis virus and determined the complete nucleotide sequence. Van Damme, E. J. M. et al. "Biosynthesis, primary structure and molecular cloning of snowdrop (*Galanthus nivalis* L.) lectin" *European Journal of Biochemistry*, 202, 23-30 (1991). Van Damme, E. J. M. et al. isolated Poly(A)-rich RNA from ripening ovaries of snowdrop lectin, yielding a single 17-kDa lectin polypeptide upon translation in a wheat-germ cell-free system. These references and others teach and disclose translational stabilizing proteins that can be used in the methods, procedures and peptide, protein and nucleotide complexes and constructs described herein.

The Intervening Linker

In addition to the text below, see Part I-1V (The Intervening Linker Peptide component, LINKER, linker, L or if polynucleotide; linker or 1 of the PEPs.

This invention also incorporates an intervening linker between ICK motif protein and the translational stabilizing protein. The intervening linker is between 1 and 30 amino acids. It can have either no cleavage sites or a protease cleavage site specific to serine-, threonine-, cysteine-, and aspartate proteases or metalloproteases. The cleavable linker can be the point of digestion by proteases found in the lepidopteran gut environment and/or the lepidopteran hemolymph environment. An example of the additional component to illustrate this invention is listed below, but it is not limited to this example.

The example for an intervening linker is IGER (SEQ ID NO: 1037) Named "IGER" The molecular weight of this intervening linker is 473.53 Daltons.

Other examples of intervening linkers can be found in the following references, which are incorporated by reference herein in their entirety: A comparison of the folding behavior of green fluorescent proteins through six different linkers is explored in Chang, H. C. et al. "De novo folding of GFP fusion proteins: high efficiency in eukaryotes but not in bacteria" *Journal of Molecular Biology*, 2005 Oct. 21; 353(2): 397-409. An isoform of the human GalNAc-Ts family, GalNAc-T2, was shown to retain its localization and functionality upon expression in *N. benthamiana* plants by Daskalova, S. M. et al. "Engineering of *N. benthamiana* L. plants for production of N-acetylgalactosamine-glycosylated proteins" *BMC Biotechnology*, 2010 Aug. 24; 10: 62. The ability of endogenous plastid proteins to travel through stromules was shown in Kwok, E. Y. et al. "GFP-labelled Rubisco and aspartate aminotransferase are present in plastid stromules and traffic between plastids" *Journal of Experimental Botany*, 2004 March; 55(397): 595-604. Epub 2004 Jan. 30. A report on the engineering of the surface of the tobacco mosaic virus (TMV), virion, with a mosquito decapeptide hormone, trypsin-modulating oostatic factor (TMOF) was made by Borovsky, D. et al. "Expression of Aedes trypsin-modulating oostatic factor on the virion of TMV: A potential larvicide" *Proc Natl Acad Sci*, 2006 Dec. 12; 103(50): 18963-18968. These references and others teach and disclose translational stabilizing proteins that can be used in the methods, procedures and peptide, protein and nucleotide complexes and constructs described herein Other Plant Transformations are More Well Known.

Methods of the invention involve introducing a nucleotide construct into a plant. By "introducing" is intended to present to the plant the nucleotide construct in such a manner that the construct gains access to the interior of a cell of the plant. The methods of the invention do not require that a particular method for introducing a nucleotide construct to a plant is used, only that the nucleotide construct gains access to the interior of at least one cell of the plant. Methods for introducing nucleotide constructs into plants are known in the art including, but not limited to, stable transformation methods, transient transformation methods, and virus-mediated methods.

By "plant" is intended whole plants, plant organs (e.g., leaves, stems, roots, etc.), seeds, plant cells, propagules, embryos and progeny of the same. Plant cells can be differentiated or undifferentiated (e.g. callus, suspension culture cells, protoplasts, leaf cells, root cells, phloem cells, pollen).

"Transgenic plants" or "transformed plants" or "stably transformed" plants or cells or tissues refers to plants that have incorporated or integrated exogenous nucleic acid sequences or DNA fragments into the plant cell. These nucleic acid sequences include those that are exogenous, or not present in the untransformed plant cell, as well as those that may be endogenous, or present in the untransformed plant cell. "Heterologous" generally refers to the nucleic acid sequences that are not endogenous to the cell or part of the native genome in which they are present, and have been added to the cell by infection, transfection, microinjection, electroporation, microprojection, or the like.

Transformation of plant cells can be accomplished by one of several techniques known in the art. The Bt-protein gene of the invention may be modified to obtain or enhance expression in plant cells. Typically a construct that expresses such a protein would contain a promoter to drive transcription of the gene, as well as a 3' untranslated region to allow transcription termination and polyadenylation. The organization of such constructs is well known in the art. In some instances, it may be useful to engineer the gene such that the resulting peptide is secreted, or otherwise targeted within the plant cell. For example, the gene can be engineered to contain a signal peptide to facilitate transfer of the peptide to the endoplasmic reticulum. It may also be preferable to engineer the plant expression cassette to contain an intron, such that mRNA processing of the intron is required for expression.

Typically this "plant expression cassette" will be inserted into a "plant transformation vector". This plant transformation vector may be comprised of one or more DNA vectors needed for achieving plant transformation. For example, it is a common practice in the art to utilize plant transformation vectors that are comprised of more than one contiguous DNA segment. These vectors are often referred to in the art as "binary vectors". Binary vectors as well as vectors with helper plasmids are most often used for Agrobacterium-mediated transformation, where the size and complexity of DNA segments needed to achieve efficient transformation is quite large, and it is advantageous to separate functions onto separate DNA molecules. Binary vectors typically contain a plasmid vector that contains the cis-acting sequences required for T-DNA transfer (such as left border and right border), a selectable marker that is engineered to be capable of expression in a plant cell, and a "gene of interest" (a gene engineered to be capable of expression in a plant cell for which generation of transgenic plants is desired). Also present on this plasmid vector are sequences required for bacterial replication. The cis-acting sequences are arranged in a fashion to allow efficient transfer into plant cells and expression therein. For example, the selectable marker gene and the Bt-protein are located between the left and right borders. Often a second plasmid vector contains the trans-acting factors that mediate T-DNA transfer from Agrobacterium to plant cells. This plasmid often contains the virulence functions (Vir genes) that allow infection of plant cells by Agrobacterium, and transfer of DNA by cleavage at border sequences and vir-mediated DNA transfer, as is understood in the art (Hellens and Mullineaux (2000) Trends in Plant Science 5:446-451). Several types of Agrobacterium strains (e.g. LBA4404, GV3101, EHA101, EHA105, etc.) can be used for plant transformation. The second plasmid vector is not necessary for transforming the plants by other methods such as microprojection, microinjection, electroporation, polyethylene glycol, etc.

In general, plant transformation methods involve transferring heterologous DNA into target plant cells (e.g. immature or mature embryos, suspension cultures, undifferentiated callus, protoplasts, etc.), followed by applying a maximum threshold level of appropriate selection (depending on the selectable marker gene) to recover the transformed plant cells from a group of untransformed cell mass. Explants are typically transferred to a fresh supply of the same medium and cultured routinely. Subsequently, the transformed cells are differentiated into shoots after placing on regeneration medium supplemented with a maximum threshold level of selecting agent. The shoots are then transferred to a selective rooting medium for recovering rooted shoot or plantlet. The transgenic plantlet then grows into a mature plant and produces fertile seeds (e.g. Hiei et al. (1994) The Plant Journal 6:271-282; Ishida et al. (1996) Nature Biotechnology 14:745-750). Explants are typically transferred to a fresh supply of the same medium and cultured routinely. A general description of the techniques and methods for generating transgenic plants are found in Ayres and Park (1994) Critical Reviews in Plant Science 13:219-239 and Bommineni and Jauhar (1997) Maydica 42:107-120. Since the transformed material contains many cells; both transformed and non-transformed cells are present in any piece of subjected target callus or tissue or group of cells. The ability to kill non-transformed cells and allow transformed cells to proliferate results in transformed plant cultures. Often, the ability to remove non-transformed cells is a limitation to rapid recovery of transformed plant cells and successful generation of transgenic plants.

Transformation protocols as well as protocols for introducing nucleotide sequences into plants may vary depending on the type of plant or plant cell, i.e., monocot or dicot, targeted for transformation. Generation of transgenic plants may be performed by one of several methods, including, but not limited to, microinjection, electroporation, direct gene transfer, introduction of heterologous DNA by Agrobacterium into plant cells (Agrobacterium-mediated transformation), bombardment of plant cells with heterologous foreign DNA adhered to particles, ballistic particle acceleration, aerosol beam transformation (U.S. Published Application No. 20010026941; U.S. Pat. No. 4,945,050; International Publication No. WO 91/00915; U.S. Published Application No. 2002015066), Lec1 transformation, and various other non-particle direct-mediated methods to transfer DNA.

Methods for transformation of chloroplasts are known in the art. See, for example, Svab et al. (1990) Proc. Natl. Acad. Sci. USA 87:8526-8530; Svab and Maliga (1993) Proc. Natl. Acad. Sci. USA 90:913-917; Svab and Maliga (1993) EMBO J. 12:601-606. The method relies on particle gun delivery of DNA containing a selectable marker and targeting of the DNA to the plastid genome through homologous recombination. Additionally, plastid transformation can be accomplished by transactivation of a silent plastid-borne transgene by tissue-preferred expression of a nuclear-encoded and plastid-directed RNA polymerase. Such a system has been reported in McBride et al. (1994) Proc. Natl. Acad. Sci. USA 91:7301-7305.

Following integration of heterologous foreign DNA into plant cells, one then applies a maximum threshold level of appropriate selection in the medium to kill the untransformed cells and separate and proliferate the putatively transformed cells that survive from this selection treatment by transferring regularly to a fresh medium. By continuous passage and challenge with appropriate selection, one identifies and proliferates the cells that are transformed with the plasmid vector. Molecular and biochemical methods can then be used to confirm the presence of the integrated heterologous gene of interest into the genome of the transgenic plant.

The cells that have been transformed may be grown into plants in accordance with conventional ways. See, for example, McCormick et al. (1986) Plant Cell Reports 5:81-84. These plants may then be grown, and either pollinated with the same transformed strain or different strains, and the resulting hybrid having constitutive expression of the desired phenotypic characteristic identified. Two or more generations may be grown to ensure that expression of the desired phenotypic characteristic is stably maintained and inherited and then seeds harvested to ensure expression of the desired phenotypic characteristic has been achieved. In this manner, the present invention provides transformed seed (also referred to as "transgenic seed") having a nucleotide construct of the invention, for example, an expression cassette of the invention, stably incorporated into their genome.

ICK and TMOF Expression in Plants.

As noted above, there are many alternatives that could be used for the components of ERSP, ICK motif protein, TMOF motif, translational stabilizing protein and intervening linker.

Evaluation of Plant Transformations

Following introduction of heterologous foreign DNA into plant cells, the transformation or integration of heterologous gene in the plant genome is confirmed by various methods such as analysis of nucleic acids, proteins and metabolites associated with the integrated gene.

PCR analysis is a rapid method to screen transformed cells, tissue or shoots for the presence of incorporated gene at the earlier stage before transplanting into the soil (Sambrook and Russell (2001) Molecular Cloning: A Laboratory Manual. Cold Spring Harbor Laboratory Press, Cold Spring Harbor, N.Y.). PCR is carried out using oligonucleotide primers specific to the gene of interest or Agrobacterium vector background, etc.

Plant transformation may be confirmed by Southern blot analysis of genomic DNA (Sambrook and Russell, 2001, supra). In general, total DNA is extracted from the transformant, digested with appropriate restriction enzymes, fractionated in an agarose gel and transferred to a nitrocellulose or nylon membrane. The membrane or "blot" is then probed with, for example, radiolabeled .sup.32P target DNA fragment to confirm the integration of introduced gene into the plant genome according to standard techniques (Sambrook and Russell, 2001, supra).

In Northern blot analysis, RNA is isolated from specific tissues of transformant, fractionated in a formaldehyde agarose gel, and blotted onto a nylon filter according to standard procedures that are routinely used in the art (Sambrook and Russell, 2001, supra). Expression of RNA encoded by the Bt-protein is then tested by hybridizing the filter to a radioactive probe derived from a Bt-protein, by methods known in the art (Sambrook and Russell, 2001, supra).

Western blot, biochemical assays and the like may be carried out on the transgenic plants to confirm the presence of protein encoded by the Bt-protein gene by standard procedures (Sambrook and Russell, 2001, supra) using antibodies that bind to one or more epitopes present on the Bt-protein.

Pesticidal Activity in Plants

In another aspect of the invention, one may generate transgenic plants expressing a Bt-protein that has pesticidal activity. Methods described above by way of example may be utilized to generate transgenic plants, but the manner in which the transgenic plant cells are generated is not critical to this invention. Methods known or described in the art such as Agrobacterium-mediated transformation, biolistic transformation, and non-particle-mediated methods may be used. Plants expressing a Bt-protein may be isolated by common methods described in the art, for example by transformation of callus, selection of transformed callus, and regeneration of fertile plants from such transgenic callus. In such process, one may use any gene as a selectable marker so long as its expression in plant cells confers ability to identify or select for transformed cells.

A number of markers have been developed for use with plant cells, such as resistance to chloramphenicol, the aminoglycoside G418, hygromycin, or the like. Other genes that encode a product involved in chloroplast metabolism may also be used as selectable markers. For example, genes that provide resistance to plant herbicides such as glyphosate, bromoxynil, or imidazolinone may find particular use. Such genes have been reported (Stalker et al. (1985) J. Biol. Chem. 263:6310-6314 (bromoxynil resistance nitrilase gene); and Sathasivan et al. (1990) Nucl. Acids Res. 18:2188 (AHAS imidazolinone resistance gene). Additionally, the genes disclosed herein are useful as markers to assess transformation of bacterial or plant cells. Methods for detecting the presence of a transgene in a plant, plant organ (e.g., leaves, stems, roots, etc.), seed, plant cell, propagule, embryo or progeny of the same are well known in the art. In one embodiment, the presence of the transgene is detected by testing for pesticidal activity.

Fertile plants expressing a Bt-protein may be tested for pesticidal activity, and the plants showing optimal activity selected for further breeding. Methods are available in the art to assay for pest activity. Generally, the protein is mixed and used in feeding assays. See, for example Marrone et al. (1985) J. of Economic Entomology 78:290-293.

Section VI. Descriptions and Examples of CRIP and Bt Protein Combinations

The Bt and ICK peptides may inhibit the growth, impair the movement, or even kill an insect when the combination of toxin is appropriately delivered to the locus inhabited by the insect. SDP 1234604, 1234605 and 609 are spray-dried powder preparations of hybrid+2-ACTX-Hv1a peptide, here "Hv1a peptide." The spray-dried Hv1a peptide powders are made from the peptide, various excipients and fermentation by-products. The '604 and '605 formulations use the same peptide, only the excipients are different. The concentration of the active hybrid peptide was quantified at about 26% weight/weight in both the '604 and '605 powders. The concentration of the active hybrid peptide was quantified at about 35% weight/weight in the 609 powders. The Hv1a peptide in each powder was quantified using a C18 rpHPLC methods known by those skilled in the art.

Inhibitory cysteine knot or ICK peptides can have remarkable stability when exposed to the environment. Many ICK peptides are isolated from venomous animals such as spiders, scorpions, and snakes. Bt proteins are well known because of their specific pesticidal activities. Surprisingly, we have found that, when Bt proteins are selectively mixed with ICK peptides, the combination of Bt and ICK peptides produces a highly effective insecticide with a potency much greater than expected.

We describe an insecticidal combination peptide composition comprising both a Bt (Bacillus thuringiensis) protein; and an insecticidal ICK (Inhibitor Cystine Knot) peptide. The composition can be in the ratio of Bt to ICK, on a dry weight basis, from about any or all of the following ratios: 99:1, 95:5, 90:10, 85:15, 80:20, 75:25, 70:30, 65:35, 60:40, 55:45, 50:50, 45:55, 40:60, 35:65, 30:70, 25:75, 20:80, 15:85, 10:90, 5:95 and 1:99, or any combination of any two of these values. We also describe a composition where the ratio of Bt to ICK, on a on a dry weight basis, is selected from about the following ratios: 0:50, 45:55, 40:60, 35:65, 30:70, 25:75, 20:80, 15:85, 10:90, 5:95, 1:99, 0.5:99.5, 0.1:99.9 and 0.01:99.99 or any combination of any two of these values.

The procedures described herein can be applied to any PFIP or CRIP peptide. The combination of PFIP and CRIP peptides includes either or both of the PFIP and CRIP peptides being are derived from more than 1 different types or bacterial strain origins for either one or both of PFIP and CRIP peptides. By bacterial strain origins we mean the peptides can be described as having been expressed by a bacterial strain that expresses the peptides with the understanding that many PFIP peptides including many Bt proteins are also artificial in the sense that they are no longer all developed from bacterial strains.

In another embodiment the combination of PFIP and CRIP peptides includes either or both of the PFIP such as Bt in combination with ICK, Non-ICK and TMOF peptides being derived from more than 1 different types or bacterial strain origins for either one or both of Bt and ICK peptides. By bacterial strain origins we mean the peptides can be described as having been expressed by a bacterial strain that expresses the peptides with the understanding that many Bt proteins are also artificial in the sense that they are no longer all developed from bacterial strains.

We also disclose compositions where either or both of the PFIP such as Bt in combination with ICK, Non-ICK and TMOF peptides are derived from between 2 and 5, 2-15, 2-30, 5-10, 5-15, 5-30, 5-50 and various other different types or bacterial strains origins of either one or both of Bt or ICK peptides. We disclose a composition where either or both of the Bt and ICK peptides are encoded by from 2 to 15 different types or bacterial strain origins of either one or both of Bt and ICK peptides. And any of these combinations of 2-5, 2-15, 2-30, 5-10, 5-15, 5-30, 5-50 and various other different types and mixtures of Bt and ICK peptides can contribute more than at least 1% of each strain type to the composition.

We disclose composition of Bt and ICK peptides where the total concentration of PFIP such as Bt in combination with ICK, Non-ICK and TMOF peptides in the composition is selected from the following percent concentrations: 1, 5, 10, 15, 20, 25, 30, 35, 40, 45, 50, 55, 60, 65, 70, 75, 80, 85, 90, 95 or 99%, or any range between any two of these values, and the remaining percentage of the composition is comprised of excipients. We disclose compositions wherein the insecticidal combination peptide is produced using a genetic cassette that further comprises an ERSP (Endoplasmic Reticulum Signal Peptide) operably linked to the ICK, Non-ICK and/or TMOF peptides insecticidal ICK peptide, wherein said ERSP is linked at the N-terminal of the insecticidal ICK peptide. We disclose compositions wherein the insecticidal combination peptide is produced using a genetic cassette that further comprises an ERSP (Endoplasmic Reticulum Signal Peptide) operably linked to the insecticidal ICK peptide, wherein said ERSP is linked at the N-terminal of the insecticidal ICK peptide, wherein the ERSP is BAAS.

We disclose compositions wherein said combination peptide is produced using a genetic cassette that further comprises a dipeptide operably linked to the insecticidal ICK peptide, wherein said dipeptide is linked at the N-terminal of the insecticidal ICK peptide; and wherein the dipeptide is comprised of one nonpolar amino acid on the N-terminal of the dipeptide and one polar amino acid on the C-terminal of the dipeptide, including embodiments where the dipeptide is glycine-serine, including embodiments where the insecticidal ICK peptide is any insecticidal peptide that inhibits both voltage-gated Calcium channels and Calcium-activated potassium channels in insects, including embodiments where the insecticidal ICK peptide origins from any species of Australian Funnel-web spider, including embodiments where the spider is selected from the Australian Funnel-web spiders of genus *Atrax* or *Hadronyche*, including embodiments where the spider is selected from the Australian Funnel-web spiders of genus *Hadronyche*, including embodiments where the spider is selected from the Australian Blue Mountains Funnel-web, *Hadronyche versuta*, including embodiments where the insecticidal ICK peptide is Hybrid-ACTX-Hv1a, including embodiments where the insecticidal ICK peptide contains 20-100 amino acids and 2-4 disulfide bonds, including embodiments where said insecticidal ICK peptide is any insecticidal peptide with at least 50%, 55%, 60%, 65%, 70%, 75%, 80%, 85%, 90%, 95%, 96%, 97%, 98%, or 99% or greater sequence identity to any of the ICK sequences disclosed herein, including embodiments where the insecticidal ICK peptide is selected from publications incorporated by reference, including embodiments where the Bt protein is any insecticidal Bt protein, including embodiments where the Bt protein is a Cry or Cyt protein, including embodiments where the Bt protein is selected from the group consisting of a Cry1, Cry3, TIC851, CryET70, Cry22, TIC901, TIC201, TIC407, TIC417, a binary insecticidal protein CryET80, and CryET76, a binary insecticidal protein TIC100 and TIC101, a combination of an insecticidal protein ET29 or ET37 with an insecticidal protein TIC810 or TIC812 and a binary insecticidal protein PS149B1, including embodiments where the Bt Protein is selected from a Cry protein, a Cry1A protein or a Cry1F protein, including embodiments where the Bt protein is a combination Cry1F-Cry1A protein, including embodiments where the Bt protein comprises an amino acid sequence at least 90% identical to SEQ ID NO: 10, 12, 14, 26, 28, or 34 of U.S. Pat. No. 7,304,206, including embodiments where the Bt Protein is DIPEL®, including embodiments where the Bt protein is THURICIDE®.

We disclose a composition comprising the nucleotides of: Bt (*Bacillus thuringiensis*) Protein; and an insecticidal ICK (Inhibitor Cystine Knot) protein, in a transformed plant or plant genome; where the ratio of Bt to ICK, on a dry weight basis, is selected from about the following ratios: 99:1, 95:5, 90:10, 85:15, 80:20, 75:25, 70:30, 65:35, 60:40, 55:45, 50:50, 45:55, 40:60, 35:65, 30:70, 25:75, 20:80, 15:85, 10:90, 5:95 and 1:99, or any combination of any two of these values.

We disclose transformed plant or plant genome wherein the ratio of PFIP such as Bt to ICK, Non-ICK and TMOF peptides; and preferably Bt to ICK, or Bt to an Anomone toxin, on a dry weight basis, is selected from about the following ratios: 50:50, 45:55, 40:60, 35:65, 30:70, 25:75, 20:80, 15:85, 10:90, 5:95, 1:99, 0.5:99.5, 0.1:99.9 and 0.01:99.99 or any combination of any two of these values. The transformed plant or plant genome may have either or both of the Bt and ICK or Bt and Anomone proteins are derived from more than 1 different type or bacterial strain origin of Bt or ICK proteins, or either or both of the Bt and ICK proteins are derived from between 2 and 5 different type or bacterial strain origin of either Bt or ICK proteins or both Bt and ICK proteins are derived from between 2 and 5 different types or strain origins, or either or both of the Bt and ICK proteins are derived from 2 to 15 different type or bacterial strain origins of either or both of Bt and ICK proteins and at least one strain of either Bt or ICK or both Bt and ICK proteins encoded by more than one copy of the Bt or ICK genes, or either or both of the Bt and ICK proteins are derived from more than one different type or bacterial strain origin of Bt and/or ICK proteins where all the strains of Bt and/or ICK proteins contribute more than at least 1% of each strain type to said composition, or either or both of the Bt and ICK proteins are derived from 2 to 5 different type or bacterial strain origins of either or both of Bt and ICK proteins and at least one strain of either Bt or ICK or both Bt and ICK proteins encoded by more than one copy of the Bt of ICK genes, or the total concentration of Bt and ICK protein in the composition can be selected from the following percent concentrations: 1, 5, 10, 15, 20, 25, 30, 35, 40, 45, 50, 55, 60, 65, 70, 75, 80, 85, 90, 95 or 99%, or any range between any two of these values, and the remaining percentage of the composition is comprised of excipients.

The compositions and plants described herein include an insecticidal combination protein produced using a genetic cassette that further comprises an ERSP (Endoplasmic Reticulum Signal Peptide) operably linked to the insecticidal ICK peptide, wherein said ERSP is linked at the N-terminal of the insecticidal ICK peptide. In another embodiment the insecticidal combination peptide is produced using a genetic cassette that further comprises an ERSP (Endoplasmic Reticulum Signal Peptide) operably linked to the insecticidal ICK peptide, wherein said ERSP is linked at the N-terminal of the insecticidal ICK peptide, wherein the ERSP is BAAS. In another embodiment the transgenic plant incorporating and expressing the combination peptides from the nucleotides described herein, wherein said combination peptide is produced using a genetic cassette that further comprises nucleotides expressing a dipeptide operably linked to the insecticidal ICK peptide, wherein said dipeptide is linked at the N-terminal of the insecticidal ICK peptide; and wherein the dipeptide is comprised of one nonpolar amino acid on the N-terminal of the dipeptide and one polar amino acid on the C-terminal of the dipeptide. In another embodiment the transgenic plant has a dipeptide that glycine-serine. In another embodiment the transgenic plant has insecticidal ICK peptides expressed that are comprised of an insecticidal peptide combination of ICK and Bt proteins. The transgenic plants can have an insecticidal ICK peptide derived from any species of Australian Funnel-web spider, or the Australian Funnel-web spiders of genus *Atrax* or *Hadronyche*, and the Australian Blue Mountains Funnel-web, *Hadronyche versuta*.

We describe and claim a transgenic plant wherein the insecticidal ICK peptide expressed is Hybrid-ACTX-Hv1a, and or the insecticidal ICK peptide expressed may contain 20-100 amino acids and 2-4 disulfide bonds and or the insecticidal ICK peptide is any insecticidal peptide with at least 50%, 55%, 60%, 65%, 70%, 75%, 80%, 85%, 90%, 95%, 96%, 97%, 98%, or 99% or greater sequence identity to any of the ICK peptides described herein. The transgenic plants disclosed can contain any known Bt protein, including peptides where the Bt protein is a Cry or Cyt protein, and/or the Bt protein is selected from the group consisting of a Cry1, Cry3, TIC851, CryET70, Cry22, TIC901, TIC201, TIC407, TIC417, a binary insecticidal protein CryET80, and CryET76, a binary insecticidal protein TIC100 and TIC101, a combination of an insecticidal protein ET29 or ET37 with an insecticidal protein TIC810 or TIC812 and a binary insecticidal protein PS149B1. The Bt protein can be selected from a Cry protein, a Cry1A protein or a Cry1F protein, or a combination Cry1F-Cry1A protein, or it comprises an amino acid sequence at least 90% identical to SEQ ID NO: 10, 12, 14, 26, 28, or 34 of U.S. Pat. No. 7,304,206. We describe a transgenic plant wherein the Bt protein is DIPEL® and we describe a transgenic plant wherein the Bt protein is THURICIDE®.

We specifically describe and claim a transformed plant expressing the peptides described herein where the average concentration of Bt and ICK peptide, in an average leaf of a transformed plant is about: 1, 5, 10, 15, 20, 25, 30, 35, 40, 45, 50, 55, 60, 65, 70, 75, 80, 85, 90, 95 or 99%, or any range between any two of these values. We specifically describe and claim a transformed plant expressing properly folded toxic peptides in the transformed plant. We specifically describe and claim a transformed plant expressing properly folded combination toxic peptides in the transformed plant and to cause the accumulation of the expressed and properly folded toxic peptides in said plant and to cause an increase in the plant's yield or resistance to insect damage and they control insect pests in crops and forestry. We describe plants made by any of the products and processes described herein.

We describe expression cassettes comprising any of the nucleotides which express any peptides described herein, including embodiments having a functional expression cassette incorporated into a transformed plant, comprising nucleotides that code for any of the peptides disclosed herein or that could be made by one skilled in the art given the teaching disclosed herein. We describe and claim procedures for the generation of transformed plants having or expressing any of the peptides described herein.

We describe the use of any of the peptides or nucleotides described herein, to make a plant or transform these peptides or nucleotides into a plant, and methods and techniques for generating these proteins in plants and/or expression cassettes comprising any of the peptides and methods to transform them into a plant genome and any method of using, making, transforming any of the described peptides or nucleotides into a plant and methods and techniques for generating transformed plants having or expressing any of the peptides and functional expression cassettes in plants comprising any of the disclosed peptides and their corresponding nucleotides and any plants made by the products and processes described herein.

In some embodiments we disclose a chimeric gene comprising a promoter active in plants operatively linked to the nucleic acids or expression cassettes as described herein. We disclose a method of making, producing, or using the combination of genes described herein. We disclose a recombinant vector comprising the combination of genes described herein. We disclose a method of making, producing, or using the recombinant vector. We disclose a transgenic host cell comprising the combination of genes described herein and the method of making, producing or using the transgenic host cell, which can be a transgenic plant cell and we disclose a method of making, producing or using such a transgenic plant cell as well as the transgenic plant comprising the transgenic plant cell and how to make and use the transgenic plant. We disclose transgenic plant and seed having the properties described herein that is derived from corn, soybean, cotton, rice, sorghum, switchgrass, sugarcane, alfalfa, potatoes or tomatoes. The transgenic seed may have a chimeric gene that we describe herein. We describe methods of making, producing or using the transgenic plant and or seed of this disclosure.

We also describe methods of using the invention and provide novel formulations. The invention is most useful to control insects. We describe a method of controlling an insect comprising: Applying Bt (*Bacillus thuringiensis*) protein to said insect; and Applying an insecticidal ICK (Inhibitor Cystine Knot) peptide to said insect. This method may be used where the Bt protein and the insecticidal ICK peptide are applied together at the same time in the same compostions or separately in different compositions and at different times. The Bt protein and the insecticidal ICK peptide may be applied sequentially, and it may be applied to (Bt protein)-resistant insects. The ratio of Bt to ICK, on a dry weight basis, can be selected from at least about the following ratios: 99:1, 95:5, 90:10, 85:15, 80:20, 75:25, 70:30, 65:35, 60:40, 55:45, 50:50, 45:55, 40:60, 35:65, 30:70, 25:75, 20:80, 15:85, 10:90, 5:95 and 1:99, or any combination of any two of these values. The ratio of Bt to ICK, on a dry weight basis, can be selected from about the following ratios: 50:50, 45:55, 40:60, 35:65, 30:70, 25:75, 20:80, 15:85, 10:90, 5:95, 1:99, 0.5:99.5, 0.1:99.9 and 0.01:99.99 or any combination of any two of these values. Either or both of the Bt and ICK peptides are derived from more than 1 different types or bacterial strain origins of Bt and ICK peptides. Either or both of the Bt and ICK peptides are derived from between 2 and 5 different types or bacterial strain origins of either Bt or ICK peptides or both Bt and ICK peptides. Either or both of the Bt and ICK peptides are derived from 2 to 15 different types or bacterial strain origins of either or both of Bt and ICK peptides and at least one strain of either Bt or ICK or both Bt and ICK peptides are encoded by more than one copy of the Bt or ICK genes. Either one or both of the Bt and ICK peptides are derived from more than 1 different types or bacterial strain origins of Bt and/or ICK peptides with all the strains of Bt and/or ICK peptides contributing more than at least 1% of the peptides from each strain type in said composition. Either or both of the Bt and ICK peptides are derived from 2 to 5 different types or bacterial strain origins of either one or both of Bt and ICK peptides and at least one strain of either Bt or ICK or both Bt and ICK peptides are encoded by more than one copy of the Bt or ICK genes. The total concentration of Bt and ICK peptide in the composition is selected from the following percent concentrations: 1, 5, 10, 15, 20, 25, 30, 35, 40, 45, 50, 55, 60, 65, 70, 75, 80, 85, 90, 95 or 99%, or any range between any two of these values, and the remaining percentage of the composition is comprised of excipients.

The methods can be used where the insecticidal combination peptide is produced using a genetic cassette that further comprises an ERSP (Endoplasmic Reticulum Signal Peptide) operably linked to the insecticidal ICK peptide, wherein said ERSP is linked at the N-terminal of the insecticidal ICK peptide. In some embodiments the insecticidal combination peptides used are produced using a genetic cassette that further comprises an ERSP (Endoplasmic Reticulum Signal Peptide) operably linked to the insecticidal ICK peptide, wherein said ERSP is linked at the N-terminal of the insecticidal ICK peptide, wherein the ERSP is BAAS.

Any of the peptides and plants described herein can be used to control insects, their growth and damage, especially their damage to plants. The combination Bt Protein and insecticidal ICK peptide can be applied by being sprayed on a plant, or the insect's locus, or the locus of a plant in need of protecting.

We also describe formulations comprising: Bt Protein; and an insecticidal ICK peptide which can include any of the compositions described herein or capable of being made by one skilled in the art given this disclosure. Some of the described formulations include the use of a polar aprotic solvent, and or water, and or where the polar aprotic solvent is present in an amount of 1-99 wt %, the polar protic solvent is present in an amount of 1-99 wt %, and the water is present in an amount of 0-98 wt %. The formulations include formulations where the Bt protein is DIPEL® and where the insecticidal ICK peptide is a hybrid-ACTX-Hv1a peptide. The polar aprotic solvent formulations are especially effective when they contain MSO. The examples below are intended to illustrate and not limit the invention in any manner.

Section VI. Descriptions and Examples of TMOF and Bt Combinations

The Bt and TMOF peptides may inhibit the growth, impair the movement, or even kill an insect when the combination of toxin is appropriately delivered to the locus inhabited by the insect. The spray-dried powders are made from the peptide, various excipients and fermentation by-products.

We describe an insecticidal combination peptide composition comprising both a Bt (*Bacillus thuringiensis*) protein; and an insecticidal TMOF peptide. The composition can be in the ratio of Bt to TMOF, on a dry weight basis, from about any or all of the following ratios: 99:1, 95:5, 90:10, 85:15, 80:20, 75:25, 70:30, 65:35, 60:40, 55:45, 50:50, 45:55, 40:60, 35:65, 30:70, 25:75, 20:80, 15:85, 10:90, 5:95 and 1:99, or any combination of any two of these values. We also describe a composition where the ratio of Bt to TMOF, on a on a dry weight basis, is selected from about the following ratios: 0:50, 45:55, 40:60, 35:65, 30:70, 25:75, 20:80, 15:85, 10:90, 5:95, 1:99, 0.5:99.5, 0.1:99.9 and 0.01:99.99 or any combination of any two of these values.

In another embodiment the combination of Bt and TMOF peptides includes either or both of the Bt and TMOF peptides being are derived from more than 1 different types or bacterial strain origins for either one or both of Bt and TMOF peptides. By bacterial strain origins we mean the peptides can be described as having been expressed by a bacterial strain that expresses the peptides with the understanding that many Bt proteins are also artificial in the sense that they are no longer all developed from bacterial strains.

We also disclose compositions where either or both of the Bt and TMOF peptides are derived from between 2 and 5, 2-15, 2-30, 5-10, 5-15, 5-30, 5-50 and various other different types or bacterial strains origins of either one or both of Bt or TMOF peptides. We disclose a composition where either or both of the Bt and TMOF peptides are encoded by from 2 to 15 different types or bacterial strain origins of either one or both of Bt and TMOF peptides. And any of these combinations of 2-5, 2-15, 2-30, 5-10, 5-15, 5-30, 5-50 and various other different types and mixtures of Bt and TMOF peptides can contribute more than at least 1% of each strain type to the composition.

We disclose composition of Bt and TMOF where the total concentration of Bt and TMOF peptide in the composition is selected from the following percent concentrations: 1, 5, 10, 15, 20, 25, 30, 35, 40, 45, 50, 55, 60, 65, 70, 75, 80, 85, 90, 95 or 99%, or any range between any two of these values, and the remaining percentage of the composition is comprised of excipients. We disclose compositions wherein the insecticidal combination peptide is produced using a genetic cassette that further comprises an ERSP (Endoplasmic Reticulum Signal Peptide) operably linked to the insecticidal TMOF peptide, wherein said ERSP is linked at the N-terminal of the insecticidal TMOF peptide. We disclose compositions wherein the insecticidal combination peptide is produced using a genetic cassette that further comprises an ERSP (Endoplasmic Reticulum Signal Peptide) operably linked to the insecticidal TMOF peptide, wherein said ERSP is linked at the N-terminal of the insecticidal TMOF peptide, wherein the ERSP is BAAS.

We disclose compositions wherein said combination peptide is produced using a genetic cassette that further comprises a dipeptide operably linked to the insecticidal TMOF peptide, wherein said dipeptide is linked at the N-terminal of the insecticidal TMOF peptide; and wherein the dipeptide is comprised of one nonpolar amino acid on the N-terminal of the dipeptide and one polar amino acid on the C-terminal of the dipeptide, including embodiments where the dipeptide is glycine-serine, including embodiments where the insecticidal TMOF peptide is any includes embodiments where the insecticidal TMOF peptide is at least 50%, 55%, 60%, 65%, 70%, 75%, 80%, 85%, 90%, 95%, 96%, 97%, 98%, or 99% or greater sequence identity to any of the TMOF sequences disclosed herein, including embodiments where the Bt Protein is any insecticidal Bt Protein, including embodiments where the Bt Protein is a Cry or Cyt protein, including embodiments where the Bt Protein is selected from the group consisting of a Cry1, Cry3, TIC851, CryET70, Cry22, TIC901, TIC201, TIC407, TIC417, a binary insecticidal protein CryET80, and CryET76, a binary insecticidal protein TIC100 and TIC101, a combination of an insecticidal protein ET29 or ET37 with an insecticidal protein TIC810 or TIC812 and a binary insecticidal protein PS149B1, including embodiments where the Bt protein is selected from a Cry protein, a Cry1A protein or a Cry1F protein, including embodiments where the Bt protein is a combination Cry1F-Cry1A protein, including embodiments where the Bt protein comprises an amino acid sequence at least 90% identical to SEQ ID NO: 10, 12, 14, 26, 28, or 34 of U.S. Pat. No. 7,304,206, including embodiments where the Bt Endotoxin is DIPEL®, including embodiments where the Bt Protein is THURICIDE®.

We disclose a composition comprising the nucleotides of: Bt (*Bacillus thuringiensis*) protein; and an insecticidal TMOF peptide, in a transformed plant or plant genome; where the ratio of Bt to TMOF, on a dry weight basis, is selected from about the following ratios: 99:1, 95:5, 90:10, 85:15, 80:20, 75:25, 70:30, 65:35, 60:40, 55:45, 50:50, 45:55, 40:60, 35:65, 30:70, 25:75, 20:80, 15:85, 10:90, 5:95 and 1:99, or any combination of any two of these values.

We disclose transformed plant or plant genome wherein the ratio of Bt to TMOF, on a dry weight basis, is selected from about the following ratios: 50:50, 45:55, 40:60, 35:65, 30:70, 25:75, 20:80, 15:85, 10:90, 5:95, 1:99, 0.5:99.5, 0.1:99.9 and 0.01:99.99 or any combination of any two of these values. The transformed plant or plant genome may have either or both of the Bt and TMOF peptides are derived from more than 1 different type or bacterial strain origin of Bt or TMOF peptides, or either or both of the Bt and TMOF peptides are derived from between 2 and 5 different type or bacterial strain origin of either Bt or TMOF peptides or both Bt and TMOF peptides are derived from between 2 and 5 different types or strain origins, or either or both of the Bt and TMOF peptides are derived from 2 to 15 different type or bacterial strain origins of either or both of Bt and TMOF peptides and at least one strain of either Bt or TMOF or both Bt and TMOF peptides encoded by more than one copy of the Bt or TMOF genes, or either or both of the Bt and TMOF peptides are derived from more than one different type or bacterial strain origin of Bt and/or TMOF peptides where all the strains of Bt and/or TMOF peptides contribute more than at least 1% of each strain type to said composition, or either or both of the Bt and TMOF peptides are derived from 2 to 5 different type or bacterial strain origins of either or both of Bt and TMOF peptides and at least one strain of either Bt or TMOF or both Bt and TMOF peptides encoded by more than one copy of the Bt of TMOF genes, or the total concentration of Bt and TMOF peptide in the composition can be selected from the following percent concentrations: 1, 5, 10, 15, 20, 25, 30, 35, 40, 45, 50, 55, 60, 65, 70, 75, 80, 85, 90, 95 or 99%, or any range between any two of these values, and the remaining percentage of the composition is comprised of excipients.

The compositions and plants described herein include an insecticidal combination peptide produced using a genetic cassette that further comprises an ERSP (Endoplasmic Reticulum Signal Peptide) operably linked to the insecticidal TMOF peptide, wherein said ERSP is linked at the N-terminal of the insecticidal TMOF peptide. In another embodiment the insecticidal combination peptide is produced using a genetic cassette that further comprises an ERSP (Endoplasmic Reticulum Signal Peptide) operably linked to the insecticidal TMOF peptide, wherein said ERSP is linked at the N-terminal of the insecticidal TMOF peptide, wherein the ERSP is BAAS. In another embodiment the transgenic plant incorporating and expressing the combination peptides from the nucleotides described herein, wherein said combination peptide is produced using a genetic cassette that further comprises nucleotides expressing a dipeptide operably linked to the insecticidal TMOF peptide, wherein said dipeptide is linked at the N-terminal of the insecticidal TMOF peptide; and wherein the dipeptide is comprised of one nonpolar amino acid on the N-terminal of the dipeptide and one polar amino acid on the C-terminal of the dipeptide. In another embodiment the transgenic plant has a dipeptide that is glycine-serine. In another embodiment the transgenic plant has insecticidal TMOF peptides expressed that are comprised of an insecticidal peptide combination of TMOF and Bt proteins. The transgenic plants can have an insecticidal TMOF peptide derived from any TMOF species.

We describe and claim a transgenic plant wherein the insecticidal TMOF peptide expressed is may contain 20-100 amino acids and or the insecticidal TMOF peptide is any insecticidal peptide with at least 50%, 55%, 60%, 65%, 70%, 75%, 80%, 85%, 90%, 95%, 96%, 97%, 98%, or 99% or greater sequence identity to any of the TMOF peptides described herein. The transgenic plants disclosed can contain any known Bt Protein, including peptides where the Bt Protein is a Cry or Cyt protein, and/or the Bt Protein is selected from the group consisting of a Cry1, Cry3, TIC851, CryET70, Cry22, TIC901, TIC201, TIC407, TIC417, a binary insecticidal protein CryET80, and CryET76, a binary insecticidal protein TIC100 and TIC101, a combination of an insecticidal protein ET29 or ET37 with an insecticidal protein TIC810 or TIC812 and a binary insecticidal protein PS149B1. The Bt Protein can be selected from a Cry protein, a Cry1A protein or a Cry1F protein, or a combination Cry1F-Cry1A protein, or it comprises an amino acid sequence at least 90% identical to SEQ ID NO: 10, 12, 14, 26, 28, or 34 of U.S. Pat. No. 7,304,206. We describe a transgenic plant wherein the Bt Protein is DIPEL® and we describe a transgenic plant wherein the Bt Protein is THURICIDE®.

We specifically describe and claim a transformed plant expressing the peptides described herein where the average concentration of Bt and TMOF peptide, in an average leaf of a transformed plant is about: 1, 5, 10, 15, 20, 25, 30, 35, 40, 45, 50, 55, 60, 65, 70, 75, 80, 85, 90, 95 or 99%, or any range between any two of these values. We specifically describe and claim a transformed plant expressing properly folded toxic peptides in the transformed plant. We specifically describe and claim a transformed plant expressing properly folded combination toxic peptides in the transformed plant and to cause the accumulation of the expressed and properly folded toxic peptides in said plant and to cause an increase in the plant's yield or resistance to insect damage and they control insect pests in crops and forestry. We describe plants made by any of the products and processes described herein.

We describe expression cassettes comprising any of the nucleotides which express any peptides described herein, including embodiments having a functional expression cassette incorporated into a transformed plant, comprising nucleotides that code for any of the peptides disclosed herein or that could be made by one skilled in the art given the teaching disclosed herein. We describe and claim procedures for the generation of transformed plants having or expressing any of the peptides described herein.

We describe the use of any of the peptides or nucleotides described herein, to make a plant or transform these peptides or nucleotides into a plant, and methods and techniques for generating these proteins in plants and/or expression cassettes comprising any of the peptides and methods to transform them into a plant genome and any method of using, making, transforming any of the described peptides or nucleotides into a plant and methods and techniques for generating transformed plants having or expressing any of the peptides and functional expression cassettes in plants comprising any of the disclosed peptides and their corresponding nucleotides and any plants made by the products and processes described herein.

In some embodiments we disclose a chimeric gene comprising a promoter active in plants operatively linked to the nucleic acids or expression cassettes as described herein. We disclose a method of making, producing, or using the combination of genes described herein. We disclose a recombinant vector comprising the combination of genes described herein. We disclose a method of making, producing, or using the recombinant vector. We disclose a transgenic host cell comprising the combination of genes described herein and the method of making, producing or using the transgenic host cell, which can be a transgenic plant cell and we disclose a method of making, producing or using such a transgenic plant cell as well as the transgenic plant comprising the transgenic plant cell and how to make and use the transgenic plant. We disclose transgenic plant and seed having the properties described herein that is derived from corn, soybean, cotton, rice, sorghum, switchgrass, sugarcane, alfalfa, potatoes or tomatoes. The transgenic seed may have a chimeric gene that we describe herein. We describe methods of making, producing or using the transgenic plant and or seed of this disclosure.

We also describe methods of using the invention and provide novel formulations. The invention is most useful to control insects. We describe a method of controlling an insect comprising: Applying Bt (*Bacillus thuringiensis*) Protein to said insect; and Applying an insecticidal TMOF peptide to said insect. This method may be used where the Bt protein and the insecticidal ICK peptide are applied together at the same time in the same compostions or separately in different compositions and at different times. The Bt Protein and the insecticidal TMOF peptide may be applied sequentially, and it may be applied to (Bt Protein)-resistant insects. The ratio of Bt to TMOF, on a dry weight basis, can be selected from at least about the following ratios: 99:1, 95:5, 90:10, 85:15, 80:20, 75:25, 70:30, 65:35, 60:40, 55:45, 50:50, 45:55, 40:60, 35:65, 30:70, 25:75, 20:80, 15:85, 10:90, 5:95 and 1:99, or any combination of any two of these values. The ratio of Bt to TMOF, on a dry weight basis, can be selected from about the following ratios: 50:50, 45:55, 40:60, 35:65, 30:70, 25:75, 20:80, 15:85, 10:90, 5:95, 1:99, 0.5:99.5, 0.1:99.9 and 0.01:99.99 or any combination of any two of these values. Either or both of the Bt and TMOF peptides are derived from more than 1 different types or bacterial strain origins of Bt and TMOF peptides. Either or both of the Bt and TMOF peptides are derived from between 2 and 5 different types or bacterial strain origins of either Bt or TMOF peptides or both Bt and TMOF peptides. Either or both of the Bt and TMOF peptides are derived from 2 to 15 different types or bacterial strain origins of either or both of Bt and TMOF peptides and at least one strain of either Bt or TMOF or both Bt and TMOF peptides are encoded by more than one copy of the Bt or TMOF genes. Either one or both of the Bt and TMOF peptides are derived from more than 1 different types or bacterial strain origins of Bt and/or TMOF peptides with all the strains of Bt and/or TMOF peptides contributing more than at least 1% of the peptides from each strain type in said composition. Either or both of the Bt and TMOF peptides are derived from 2 to 5 different types or bacterial strain origins of either one or both of Bt and TMOF peptides and at least one strain of either Bt or TMOF or both Bt and TMOF peptides are encoded by more than one copy of the Bt or TMOF genes. The total concentration of Bt and TMOF peptide in the composition is selected from the following percent concentrations: 1, 5, 10, 15, 20, 25, 30, 35, 40, 45, 50, 55, 60, 65, 70, 75, 80, 85, 90, 95 or 99%, or any range between any two of these values, and the remaining percentage of the composition is comprised of excipients.

The methods can be used where the insecticidal combination peptide is produced using a genetic cassette that further comprises an ERSP (Endoplasmic Reticulum Signal Peptide) operably linked to the insecticidal TMOF peptide, wherein said ERSP is linked at the N-terminal of the insecticidal TMOF peptide. In some embodiments the insecticidal combination peptides used are produced using a genetic cassette that further comprises an ERSP (Endoplasmic Reticulum Signal Peptide) operably linked to the insecticidal TMOF peptide, wherein said ERSP is linked at the N-terminal of the insecticidal TMOF peptide, wherein the ERSP is BAAS.

Any of the peptides and plants described herein can be used to control insects, their growth and damage, especially their damage to plants. The combination Bt protein and insecticidal TMOF peptide can be applied by being sprayed on a plant, or the insect's locus, or the locus of a plant in need of protecting.

We also describe formulations comprising: Bt proteins; and an insecticidal TMOF peptide which can include any of the compositions described herein or capable of being made by one skilled in the art given this disclosure. Some of the described formulations include the use of a polar aprotic solvent, and or water, and or where the polar aprotic solvent is present in an amount of 1-99 wt %, the polar protic solvent is present in an amount of 1-99 wt %, and the water is present in an amount of 0-98 wt %. The formulations include formulations where the Bt protein is DIPEL® and where the insecticidal TMOF peptide is a peptide like any of the TMOF peptides provided in the sequence listing. The polar aprotic solvent formulations are especially effective when they contain MSO. The examples below are intended to illustrate and not limit the invention in any manner.

To summarize, we describe in Part 3, the following:

A composition comprising at least two types of insecticidal protein or peptides wherein one type is a Pore Forming Insecticidal Protein (PFIP) and the other type is a Cysteine Rich Insecticidal Peptide (CRIP). Where the composition can comprise at least two types of insecticidal peptides wherein one type is Pore Forming Insecticidal Protein (PFIP), wherein said PFIP is a Bt protein and the other type is Cysteine Rich Insecticidal Peptide (CRIP), wherein said CRIP is an ICK protein, wherein said ICK protein is derived from the funnel web spider. We describe a process of: a) evaluation and optional testing of an insect or a sample of insects to determine whether or not the insects show resistance to a PFIP and b) when the result of said evaluation leads to the conclusion that said sample of insects are resistant to a PFIP then c) the application of one or more CRIPS and optionally the CRIPS can be an ICK from *Hadronyche versuta*, or the Blue Mountain funnel web spider, *Atrax robustus, Atrax formidabilis, Atrax infensus*, including toxins known as U-ACTX polypetides, U-ACTX-Hv1a, rU-ACTX-Hv1a, rU-ACTX-Hv1b, or mutants or variants, or the CRIP can be a Non-ICK from sea anemones, from the sea anemone named *Anemonia viridi*, the peptides named Av2 and Av3 especially peptides of similar to these in the sequence listing. We describe a method of controlling Insects including Bt resistant insects comprising, creating composition of at least two types of peptides wherein one type of peptide is a pore forming insecticidal peptide (PFIP) and the other type of peptide is a cysteine rich insecticidal peptide (CRIP) and the PFIP and CRIP proteins are selected from any of the compositions described herein and from any of the proteins provided in the sequence listing and then applying said composition to the locus of the insect. We describe a method of controlling Insects including Bt resistant insects comprising protecting a plant from Bt resistant insects comprising, creating a plant which expresses a combination of at least two properly folded peptides wherein one type of peptide is a pore forming insecticidal peptide (PFIP) and the other type of peptide is a cysteine rich insecticidal peptide (CRIP) and the PFIP and CRIP proteins are selected from any of the compositions described herein and from any of the proteins provided in the sequence listing. We describe a process of. a) evaluation and optional testing of an insect or a sample of insects to determine whether or not the insects show resistance to a PFIP and b) when the result of said evaluation leads to the conclusion that said sample of insects are resistant to a PFIP then c) the application of one or more CRIPS and optionally d) the application of a combination of PFIP and CRIP, in either concurrent or sequential applications.

We describe a composition comprising at least two types of insecticidal protein or peptides wherein one type is a Pore Forming Insecticidal Protein (PFIP) and the other type is a Cysteine Rich Insecticidal Peptide (CRIP). A composition where the CRIP is a ICK and optionally, said ICK is derived from, or originates from, *Hadronyche versuta*, or the Blue Mountain funnel web spider, *Atrax robustus, Atrax formidabilis, Atrax infensus*, including toxins known as U-ACTX polypetides, U-ACTX-Hv1a, rU-ACTX-Hv1a, rU-ACTX-Hv1b, or mutants or variants. A composition where the CRIP is a Non-ICK CRIP and optionally said Non-ICK CRIP is derived from, or originates from, animals having Non-ICK CRIPS such as sea anemones, sea urchins and sea slugs, optionally including the sea anemone named *Anemonia viridi*, optionally including the peptides named Av2 and Av3 especially peptides similar to Av2 and Av3 including such peptides listed in the sequence listing or mutants or variants. A method of using the composition control Insects including Bt resistant insects comprising, creating composition of at least two types of peptides wherein one type of peptide is a pore forming insecticidal protein (PFIP) and the other type of peptide is a cysteine rich insecticidal peptide (CRIP) and the PFIP and CRIP proteins are selected from any of the compositions described herein and from any of the proteins provided in the sequence listing and then applying said composition to the locus of the insect. A method controlling Insects including Bt resistant insects comprising protecting a plant from Bt resistant insects comprising, creating a plant which expresses a combination of at least two properly folded peptides wherein one type of peptide is a pore forming insecticidal protein (PFIP) and the other type of peptide is a cysteine rich insecticidal peptide (CRIP) and the PFIP and CRIP proteins are selected from any of the compositions described herein and from any of the proteins provided in the sequence listing. A method of controlling insects including Bt resistant insects where the CRIP is administered any time during which the PFIP is affecting the lining of the insect gut. A method of controlling insects including Bt resistant insects where the CRIP is administered following the testing of the insect for Bt resistance and wherein said insect tested positive for Bt resistance. The application or delivery of any of the compounds described herein in solid or liquid form to either the insect, the locus of the insect or as a Plant Incorporated Protectant.

We describe a composition comprising at least two types of insecticidal peptides wherein one type is a pore forming insecticidal protein (PFIP), wherein said PFIP is a cry protein and the other type is a cysteine rich insecticidal peptide (CRIP), wherein said CRIP is an ICK protein, wherein said ICK protein is derived from the funnel web spider. We describe a composition comprising at least two types of insecticidal peptides wherein one type is a pore forming insecticidal peptide (PFIP), wherein said PFIP has as its origin the Bt organism and the other type is a cysteine rich insecticidal peptide (CRIP), wherein said CRIP is a Non-ICK protein. We describe a composition comprising at least two types of insecticidal peptides wherein one type is a pore forming insecticidal peptide (PFIP) and the other type is a TMOF. We describe a method of protecting a plant from Insects including Bt resistant insects comprising creating a Plant Incorporating a combination of at least two different types of peptides wherein one type of peptide is a pore forming insecticidal peptide (PFIP) and the other type is a cysteine rich insecticidal peptide (CRIP). We describe a method of protecting a plant from Insects including Bt resistant insects comprising, creating a plant which expresses a combination of at least two properly folded peptides wherein one type of peptide is a pore forming insecticidal peptide (PFIP) and the other type of peptide is a cysteine rich insecticidal peptide (CRIP) and the PFIP and CRIP proteins are selected from any of the compositions described herein and from any of the proteins provided in the sequence listing.

We describe an insecticidal combination peptide composition comprising Cysteine Rich Insecticidal protein (CRIP); such as an insecticidal ICK (Inhibitor Cystine Knot) peptide like a spider peptide or Non-ICK like a sea anemone toxin combined with a with pore forming insecticidal protein (PFIP) like a Bt peptide, such as cry, cyp or VIP; or a or a Cysteine Rich Insecticidal protein (CRIP); such as an insecticidal ICK (Inhibitor Cystine Knot) peptide combined with a with a TMOF (trypsin modulating oostatic factor) peptide. Note the CRIP can be a Non-ICK protein like a sea anemone peptide, such as Av2 and Av3 and other similar sequences in the Sequence Listing. We describe such compositions where the ratio of Bt to CRIP, Bt to ICK, Bt to non-ICK CRIP, Bt to TMOF, or Bt to ICK and TMOF on a dry weight basis, is selected from about the following ratios: 99:1, 95:5, 90:10, 85:15, 80:20, 75:25, 70:30, 65:35, 60:40, 55:45, 50:50, 45:55, 40:60, 35:65, 30:70, 25:75, 20:80, 15:85, 10:90, 5:95 and 1:99, or any combination of any two of these values.

Alternatively where the ratio of Bt to CRIP, Bt to ICK, Bt to non-ICK CRIP, Bt to TMOF, and TMOF, and sea anemone on a on a dry weight basis, is selected from about the following ratios: 50:50, 45:55, 40:60, 35:65, 30:70, 25:75, 20:80, 15:85, 10:90, 5:95, 1:99, 0.5:99.5, 0.1:99.9 and 0.01:99.99 or any combination of any two of these values. Alternatively where ratio of Bt to CRIP, Bt to ICK, Bt to non-ICK CRIP, Bt to TMOF, or Bt to ICK and TMOF, and sea anemone peptides are derived from more than 1 different types or bacterial strain origins of either one or both of Bt and ICK peptides. Alternatively where the Bt, ICK, non-ICK CRIP, sea anemone peptides and TMOF peptides are derived from between 2 and 5 different types or bacterial strains origins of either one or both of Bt, ICK, non-ICK CRIP, sea anemone peptides and TMOF peptides peptides are derived from between 2 and 5 different strains. Alternatively where either or both of the Bt, ICK, non-ICK CRIP, sea anemone peptides and TMOF peptides are derived from 2 to 5 different types or bacterial strain origins of either one or all of Bt, ICK, non-ICK CRIP, sea anemone peptides and TMOF peptides. Alternatively where either or both of the Bt, ICK, non-ICK CRIP, sea anemone peptides and TMOF peptides are encoded by from 2 to 15 different types or bacterial strain origins of either one or all of Bt, ICK, non-ICK CRIP, sea anemone peptides and TMOF peptides. Alternatively where one or all of the Bt, ICK, non-ICK CRIP, sea anemone peptides and TMOF peptides are derived from 2 to 15 different types or bacterial strain origins of either one or all of Bt, ICK, and TMOF peptides and at least one strain of either Bt, ICK, non-ICK CRIP, sea anemone peptides and TMOF peptides or both Bt, ICK, non-ICK CRIP, sea anemone peptides and TMOF peptides and Bt and ICK, Bt and TMOF, or Bt and ICK+TMOF peptides are encoded by more than one copy of the Bt or ICK genes. Alternatively where either or both of the Bt, CRIP, ICK, non-ICK CRIP, sea anemone peptides and TMOF peptides are derived from 2 to 15 strains or bacterial types of Bt and/or ICK, non-ICK CRIP, sea anemone peptides and TMOF peptides peptides with all the strains of Bt and/or ICK peptides contributing more than at least 1% of each strain type to said composition.

We describe a composition of Bt and ICK, non-ICK CRIP, sea anemone peptides and TMOF peptides of numbers 1-9 where the total concentration of Bt and CRIP peptide in the composition is selected from the following percent concentrations: 1, 5, 10, 15, 20, 25, 30, 35, 40, 45, 50, 55, 60, 65, 70, 75, 80, 85, 90, 95 or 99%, or any range between any two of these values, and the remaining percentage of the composition is comprised of excipients. We describe a composition wherein the insecticidal combination peptide is produced using a genetic cassette that further comprises an ERSP (Endoplasmic Reticulum Signal Peptide) operably linked to the insecticidal CRIP peptide, wherein said ERSP is linked at the N-terminal of the insecticidal CRIP peptide. We describe a composition wherein the insecticidal combination peptide is produced using a genetic cassette that further comprises an ERSP (Endoplasmic Reticulum Signal Peptide) operably linked to the insecticidal ICK peptide, wherein said ERSP is linked at the N-terminal of the insecticidal CRIP peptide, wherein the ERSP is BAAS. We describe a composition wherein said combination peptide is produced using a genetic cassette that further comprises a dipeptide operably linked to the insecticidal CRIP peptide, wherein said dipeptide is linked at the N-terminal of the insecticidal CRIP peptide; and wherein the dipeptide is comprised of one nonpolar amino acid on the N-terminal of the dipeptide and one polar amino acid on the C-terminal of the dipeptide. We describe a composition wherein said dipeptide is glycine-serine.

We describe a composition wherein the insecticidal CRIP peptide is any insecticidal peptide that inhibits both voltage-gated Calcium channels and Calcium-activated potassium channels in insects, and wherein the insecticidal CRIP peptide origins from any species of Australian Funnel-web spider, and wherein said spider is selected from the Australian Funnel-web spiders of genus *Atrax* or *Hadronyche*, and wherein said spider is selected from the Australian Funnel-web spiders of genus *Hadronyche*, and wherein said spider is selected from the Australian Blue Mountains Funnel-web, *Hadronyche versuta*, and wherein the insecticidal CRIP peptide is Hybrid-ACTX-Hv1a, and wherein said insecticidal CRIP peptide contains 20-100 amino acids and 2-4 disulfide bonds, wherein said insecticidal CRIP peptide is any insecticidal peptide with at least 50%, 55%, 60%, 65%, 70%, 75%, 80%, 85%, 90%, 95%, 96%, 97%, 98%, or 99% or greater sequence identity to any of the peptides in the sequence listing.

We describe insecticidal CRIP peptide is from Bt protein and where the Bt protein is a Cry or Cyt protein, or selected from the group consisting of a Cry1, Cry3, TIC851, CryET70, Cry22, TIC901, TIC201, TIC407, TIC417, a binary insecticidal protein CryET80, and CryET76, a binary insecticidal protein TIC100 and TIC101, a combination of an insecticidal protein ET29 or ET37 with an insecticidal protein TIC810 or TIC812 and a binary insecticidal protein PS149B1. We describe Bt protein selected from a Cry protein, a Cry1A protein or a Cry1F protein. We describe wherein said Bt protein is a combination Cry1F-Cry1A protein, DIPEL® or THURICIDE® and where the Bt protein is derived from *Bacillus thuringiensis* kurstaki.

We describe compositions comprising the nucleotides of a PFIP such as Bt (*Bacillus thuringiensis*) protein; and a CRIP such as an insecticidal ICK (Inhibitor Cystine Knot) peptide, or a Non-ICK peptide; in a transformed plant or plant genome; and where the ratio of Bt to ICK, on a dry weight basis, is selected from about the following ratios: 99:1, 95:5, 90:10, 85:15, 80:20, 75:25, 70:30, 65:35, 60:40, 55:45, 50:50, 45:55, 40:60, 35:65, 30:70, 25:75, 20:80, 15:85, 10:90, 5:95 and 1:99, or any combination of any two of these values, or where the composition of number 33, in a transformed plant or plant genome and wherein the ratio of Bt to ICK, on a dry weight basis, is selected from about the following ratios: 0:50, 45:55, 40:60, 35:65, 30:70, 25:75, 20:80, 15:85, 10:90, 5:95, 1:99, 0.5:99.5, 0.1:99.9 and 0.01:99.99 or any combination of any two of these values.

We describe a composition where either or both of the encoded Bt and ICK peptides are derived from more than 1 different type or bacterial strain origin of Bt or ICK peptides, where either or both of the encoded Bt and ICK peptides are derived from between 2 and 5 different type or bacterial strain origin of either Bt or ICK peptides or both Bt and ICK peptides are derived from between 2 and 5 different types or strain origins, where either or both of the encoded Bt and ICK peptides are derived from 2 to 15 different type or bacterial strain origins of either or both of Bt and ICK peptides and at least one strain of either Bt or ICK or both Bt and ICK peptides encoded by more than one copy of the Bt or ICK genes, where either or both of the encoded Bt and ICK peptides are derived from more than one different type or bacterial strain origin of Bt and/or ICK peptides where all the strains of Bt and/or ICK peptides contribute more than at least 1% of each strain type to said composition, where either or both of the encoded Bt and ICK peptides are derived from 2 to 5 different type or bacterial strain origins of either or both of Bt and ICK peptides and at least one strain of either Bt or ICK or both Bt and ICK peptides encoded by more than one copy of the Bt of ICK genes.

We describe a composition where the total concentration of transgenically expressed Bt and ICK peptide resulting from the composition is selected from the following percent concentrations: 1, 5, 10, 15, 20, 25, 30, 35, 40, 45, 50, 55, 60, 65, 70, 75, 80, 85, 90, 95 or 99%, or any range between any two of these values, and the remaining percentage of the composition is comprised of excipients. We describe a composition where the insecticidal combination peptide is produced using a genetic cassette that further comprises an ERSP (Endoplasmic Reticulum Signal Peptide) operably linked to the insecticidal ICK peptide, wherein said ERSP is linked at the N-terminal of the insecticidal ICK peptide, and where the insecticidal combination peptide is produced using a genetic cassette that further comprises an ERSP (Endoplasmic Reticulum Signal Peptide) operably linked to the insecticidal CRIP peptide, wherein said ERSP is linked at the N-terminal of the insecticidal CRIP peptide, wherein the ERSP is BAAS.

We describe a transgenic plant incorporating and expressing the combination peptides disclosed herein where said combination peptide is produced using a genetic cassette that further comprises nucleotides expressing a dipeptide operably linked to the insecticidal CRIP (peptide), wherein said dipeptide is encoded so that it is covalently linked at the N-terminal of the insecticidal CRIP; and wherein the dipeptide is comprised of one nonpolar amino acid on the N-terminal of the dipeptide and one polar amino acid on the C-terminal of the dipeptide. We describe a transgenic plant wherein the transformed peptide includes a dipeptide with an N terminal glycine-serine. We describe transgenic plant wherein the insecticidal peptides expressed are any insecticidal peptide combination of CRIP and PFIP (or Bt peptides) that allows the peptide to both enter the gut and then inhibits both voltage-gated Calcium channels and Calcium-activated potassium channels in insects.

We describe a transgenic plant wherein the recombinantly produced insecticidal CRIP peptide is derived from an Australian Funnel-web spider or sea anemone and we describe and provide either real or notional examples of transformed plants, transformed with a CRIP from a spider is selected from the Australian Funnel-web spiders of genus *Atrax* or *Hadronyche* or a sea anemone is selected from *Anemonia viridis*. The transgenic plant can have insecticidal ICK peptide expressed that is Hybrid-ACTX-Hv1a. The CRIP can be an ICK or Non-ICK that when expressed contains 20-100 amino acids and 2-4 disulfide bonds. The PIP peptides can have at least 50%, 55%, 60%, 65%, 70%, 75%, 80%, 85%, 90%, 95%, 96%, 97%, 98%, or 99% or greater sequence identity to SEQ ID NO: 33 and or peptide selected from SEQ ID NO: 33-1032.

We describe a transgenic plant wherein the Bt protein is any insecticidal Bt protein and where the Bt protein is a Cry or Cyt protein, and where the Bt protein is selected from the group consisting of a Cry1, Cry3, TIC851, CryET70, Cry22, TIC901, TIC201, TIC407, TIC417, a binary insecticidal protein CryET80, and CryET76, a binary insecticidal protein TIC100 and TIC101, a combination of an insecticidal protein ET29 or ET37 with an insecticidal protein TIC810 or TIC812 and a binary insecticidal protein PS149B1 and where the Bt protein is selected from a Cry protein, a Cry1A protein or a Cry1F protein, and where the Bt protein is a combination Cry1F-Cry1A protein, and/or DIPEL® and or THURICIDE®.

We describe a transgenic plant wherein the average concentration of Bt and ICK/Non-ICK peptide, in an average leaf of a transformed plant is about: 1, 5, 10, 15, 20, 25, 30, 35, 40, 45, 50, 55, 60, 65, 70, 75, 80, 85, 90, 95 or 99% of total recoverable soluble protein, or any range between any two of these values, and where the transformed plant expressing the peptides properly folded toxic peptides in the transformed plant, and where it causes the accumulation of the expressed and properly folded toxic peptides in said plant and to cause an increase in the plant's yield or resistance to insect damage. We describe these compositions and procedures to control insects.

We describe expression cassettes comprising any of the nucleotides which express any peptides mentioned here. We describe a functional expression cassette incorporated into a transformed plant, comprising nucleotides that code for any of the peptides disclosed herein or that could be made by one skilled in the art given the teaching disclosed herein. We describe procedures for the generation of transformed plants having or expressing any of the combination peptides described herein. We describe a plant made by any of the products and processes described herein.

We describe the use of any of the peptides or nucleotides described herein, to make a plant or transform these peptides or nucleotides into a plant, and methods and techniques for generating these proteins in plants and/or expression cassettes comprising any of the peptides and methods to transform them into a plant genome and any method of using, making, transforming any of the described peptides or nucleotides into a plant and methods and techniques for generating transformed plants having or expressing any of the peptides and functional expression cassettes in plants comprising any of the disclosed peptides and their corresponding nucleotides and any plants made by the products and processes described herein.

We describe a chimeric gene comprising a promoter active in plants operatively linked to the nucleic acids or expression cassettes as described herein and the methods of making, producing, or using the combination of genes described herein. We describe a recombinant vector comprising the combination of genes described herein. We describe a method of making, producing, or using the recombinant vectors, a transgenic host cell comprising the combination of genes, the transgenic host cell which is a transgenic plant cell, the transgenic plant and transgenic plants which are corn, soybean, cotton, rice, sorghum, switchgrass, sugarcane, alfalfa, potatoes or tomatoes, and the seeds for these and other plants, and where the seed comprises a chimeric gene.

We describe methods of controlling an insect or the locus of an insect comprising: applying a PFIP, like Bt (*Bacillus thuringiensis*) protein to said insect; followed with an application of any or any combination of the following: a cysteine rich insecticidal peptide (CRIP) to said insect and in combination or in the alternative, applying an insecticidal ICK (Inhibitor Cystine Knot) peptide to said insect and in combination or in the alternative, applying a Non-ICK CRIP peptide to said insect and in combination or in the alternative, applying a TMOF peptide to said insect, applying a sea anemone peptide to said insect.

We explain that Bt protein and the insecticidal CRIP, ICK and or TMOF peptide are applied such that they work together, but they do not have to be applied at the same time. The PFIP like a Bt protein and the insecticidal CRIP, ICK and or TMOF peptide can be are applied concurrently or sequentially.

We explain the amounts as follows: the ratio of Bt to CRIP, Bt to ICK, Bt to non-ICK CRIP, Bt to TMOF, or Bt to ICK and TMOF; on a dry weight basis, is selected from about the following ratios: 99:1, 95:5, 90:10, 85:15, 80:20, 75:25, 70:30, 65:35, 60:40, 55:45, 50:50, 45:55, 40:60, 35:65, 30:70, 25:75, 20:80, 15:85, 10:90, 5:95 and 1:99, or any combination of any two of these values; alternatively, the ratio of Bt to CRIP, Bt to ICK, Bt to non-ICK CRIP, Bt to TMOF, or Bt to ICK and TMOF; on a on a dry weight basis, is selected from about the following ratios: 50:50, 45:55, 40:60, 35:65, 30:70, 25:75, 20:80, 15:85, 10:90, 5:95, 1:99, 0.5:99.5, 0.1:99.9 and 0.01:99.99 or any combination of any two of these values.

We explain both or all of the Bt+CRIP; Bt+ICK, Bt+Non-ICK CRIP, Bt+TMOF or Bt+ICK+TMOF; are derived from more than 1 different types or bacterial strain origins of Bt, o ICK, and TMOF peptides and or both of the Bt and CRIP, ICK, non-ICK CRIP, Bt and TMOF or Bt and ICK+TMOF; Bt+sea anemone peptides peptides are derived from between 2 and 5 different types or bacterial strain origins of either one, two or more of Bt, CRIP, ICK, non-ICK CRIP, sea anemone peptides or TMOF peptides, and or either one, two or all Bt, ICK and TMOF peptides are derived from 2 to 15 different types or bacterial strain origins of either or both of Bt and ICK peptides and at least one strain of either one, two or all of Bt, CRIP, ICK, non-ICK CRIP, sea anemone peptides or TMOF peptides are encoded by more than one copy one, two or all of Bt, CRIP, ICK, non-ICK CRIP, sea anemone peptides or TMOF genes.

We explain that one, two or all Bt, ICK and TMOF peptides are derived from more than 1 different types or bacterial strain origins of one, two or all Bt, ICK and TMOF peptides with all the strains of one, two or all Bt, ICK and TMOF peptides contributing more than at least 1% of the peptides from each strain type in said composition. The total concentration of Bt and CRIP peptide in the composition is selected from the following percent concentrations: 1, 5, 10, 15, 20, 25, 30, 35, 40, 45, 50, 55, 60, 65, 70, 75, 80, 85, 90, 95 or 99%, or any range between any two of these values, and the remaining percentage of the composition is comprised of excipients.

We either provide or provide enough information that one skilled in the art could make a formulation comprising: a PFIP such as a Bt protein; and a CRIP such as an insecticidal ICK or Non-ICK peptide; and/or a TMOF peptide. We explain such formulations could be made using a polar aprotic solvent and a polar protic solvent and further comprising water. In some formulations the polar aprotic solvent is present in an amount of 1-99 wt %, the polar protic solvent is present in an amount of 1-99 wt %, and the water is present in an amount of 0-98 wt %, and it can further comprise MSO.

Example 1

Foliar Bioassay Using SDP 1234604 and 1234605 Against *Spodoptera exigua* on Mud Lakes Farms Romaine Lettuce Purpose: The purpose of this experiment is designed to determine the percent mortality which occurs against *S. exigua* when SDP 1234604 (wp formulation) and 605 (pregran formulation) are sprayed against 1st, 2nd, 3rd and 4th Instar larvae in a foliar leaf disk bioassay.

Assay Preparation and Treatment Formulation: *S. exigua* eggs were received from Benzon Research. Eggs were placed at 10° C. in the wine cooler for two days then moved to the VWR Low Temperature Incubator set at 28° C. and 2-30% Relative Humidity on a rack under LED lights, until freshly hatched neonate were ~24 hr old for the first experiment. Mud Lake Farms Lettuce was received on Jul. 9, 2012 and stored at 4° C. in a refrigerator until used. For each instar, larvae were placed on mud lakes farms lettuce after 24 hours in the incubator. Lettuce leaves were cut and placed into a medium square polyethylene container and larvae were tapped into the container. After 24 hours, larvae were removed from the old lettuce and fresh lettuce was replaced so that larvae were not reared on less than superior tissue. This occurred once a day, for three days, until larvae were 96 hours old. Lettuce leaves were cut into disks using a 2¼ inch arch which has been sanitized with 70% ethanol and cleaned to remove any leaf tissue from previous assays. Leaf disks were punched on a true bamboo cutting board. A very dilute 12 ppm bleach solution (1/500th dilution of 6ppt hypochlorite {Clorox Bleach}Stock) was used to sanitize the leaf tissue without damaging leaf disks before the quadruple rinse. Leaf disks were subjected to the 12 ppm bleach treatment by placing the cut leaf disk in a 12 ppm solution of bleach in a large rectangular polyethylene container (covered with a lid) and shaking at 3500 rpm on an orbital shaker for 1.5 minutes. Bleach solution was then drained from the bin and leaves were rinsed in bins with $dH_2O$ four times to remove residual bleach with slight agitation in $diH_2O$ on the orbital shaker. Leaf disks were placed onto the paper towels and covered with additional paper towels so that they do not dry out. Only the flattest, circular and uniform disks were then hand dried with Kimwipes to remove any remaining water and placed into labeled Tupperware containers abaxial side up for spraying. During this time, formulations were made (as described in the table that follows) for the spray solutions of spray dried powders on the leaf disks in 50 mL Falcon tube being sure to fill tubes with deionized $H_2O$ before adding the precisely massed amount of spray dried powders. Spraying was performed in the Labconco fume hood in E207 starting with the ventral side of the leaf disk. For spraying, a double action, internal mix airbrush (Paasch Airbrush Company, Chicago IL) with the airline set at a rate of 200 µL/second (20 psi). Leaf disks were sprayed in a circular fashion with the airbrush perpendicular to the leaf surface so that a fine mist covered the entire leaf surface evenly (~3-4 seconds). Between each treatment spray, the cup containing spray solution was rinsed with $dH_2O$ to remove any residues from previous treatments. After spraying, drying was allowed for one hour then disks were flipped so their adaxial side was now orientated facing up in the Tupperware Container and sprayed in the same manner. After spraying the adaxial side, an hour was allowed for drying and leaf disks were placed in labeled petri dishes with 2 90 mm Whatman 3 Qualitative Filter Papers (GE Healthcare UK Limited, Amersham Place Little Chalfont, Buckinghamshire, HP7 9NA, UK) at the bottom that have been wetted with 4 mL of diH2O using a Eppendorf Repeater Plus and a 25 mL tip. Petri dishes were covered and randomized before ~7-9 freshly hatched neonates *S. exigua* were applied to each leaf disk using a #0 fine haired brush by obtaining a white board and emptying a container of 24, 48, 72 or 96 hr neonates onto it. Plates were sealed with parafilm and placed randomly on the rack for statistical purposes at 27° C. The assay was scored over the following day at 18, 24, 40 and 48 hours by observing mortality and noting any differences between untreated and treated leaves.

Figure 19:
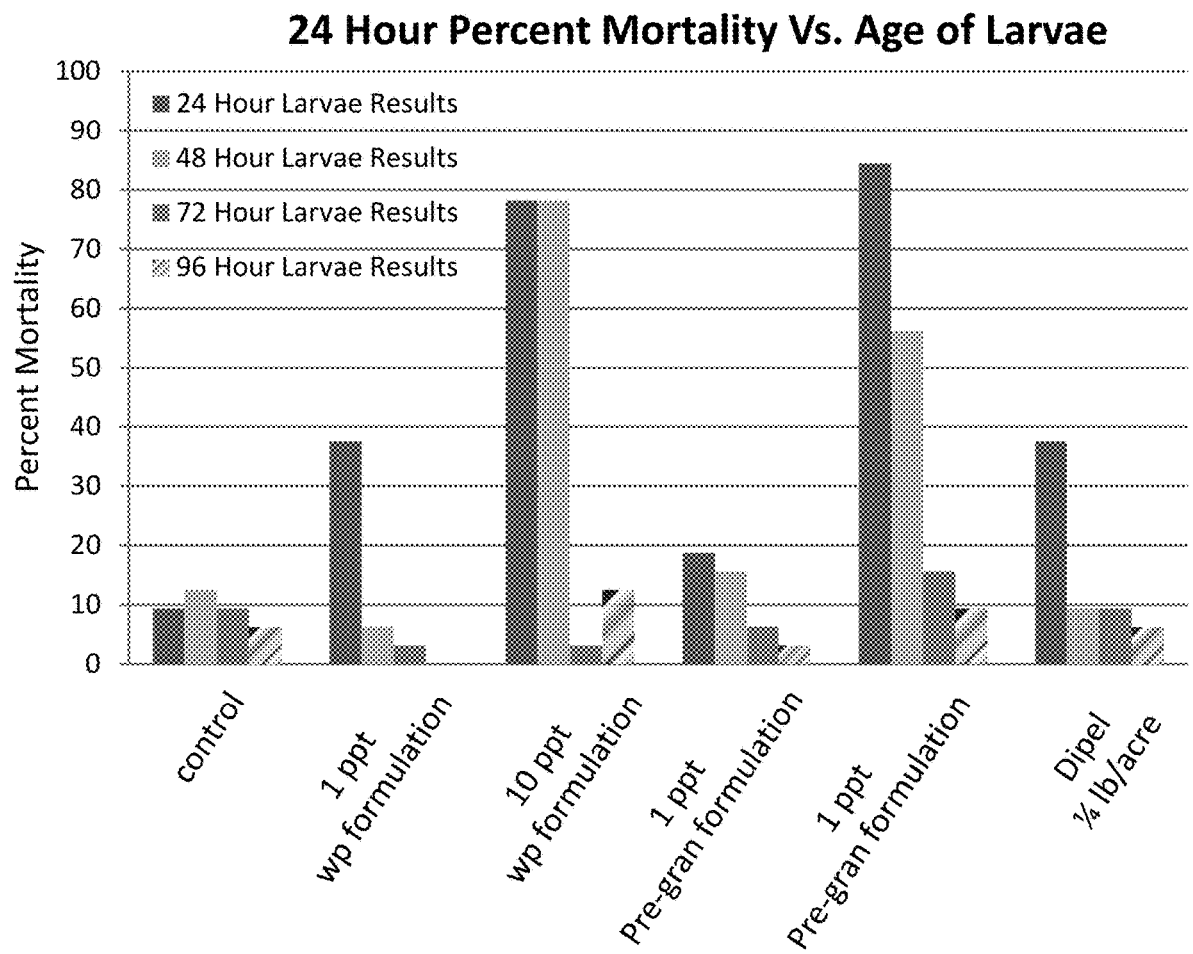
FIG. 19 Graph of a foliar bioassay 24 hour percent mortality vs. age of larvae after application and exposure to ICK peptides or Bt proteins.
Figure 20:
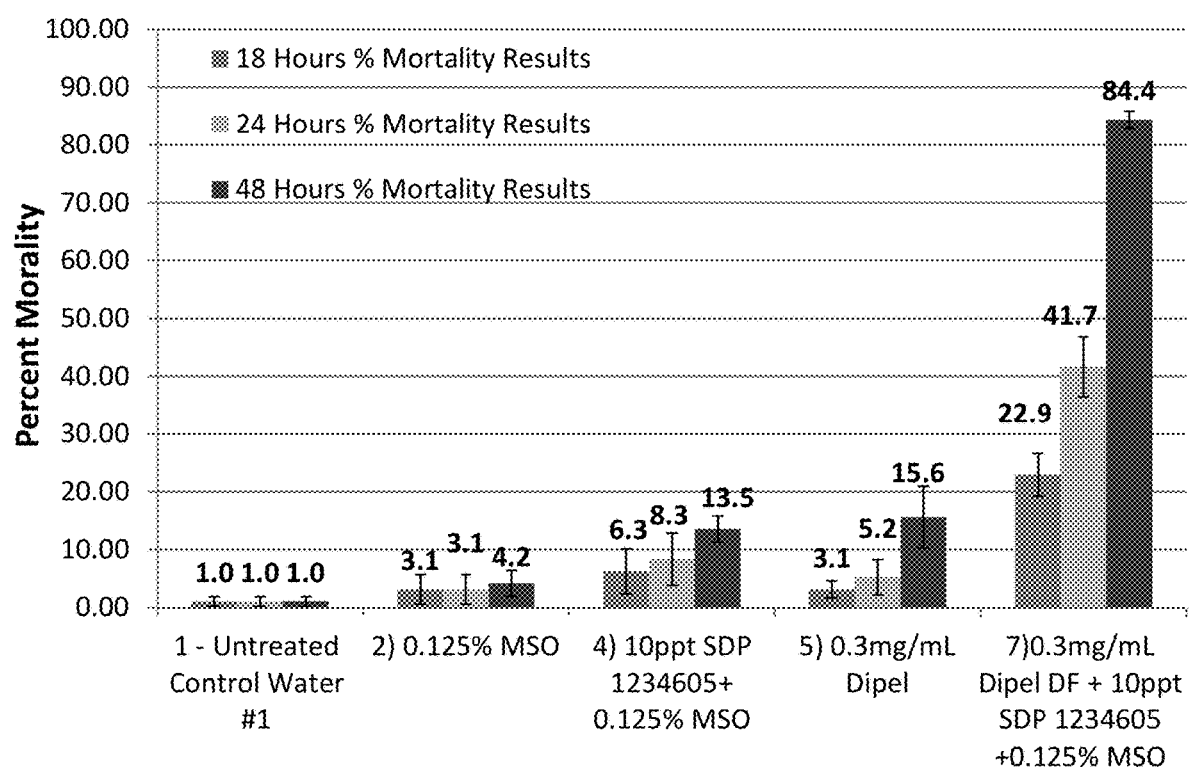
FIG. 20 Graph of a foliar bioassay measuring percent mortality at 18, 24 and 48 hour post application using Bt proteins or ICK peptides or combination of Bt+ICK peptides on 72 hour larvae.
Figure 21:
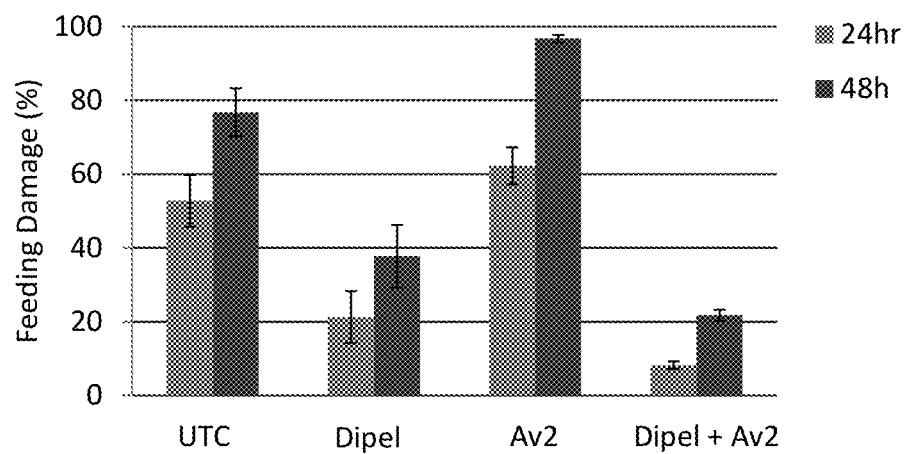
FIG. 21 Graph of a foliar feeding bioassay measuring foliar damage by insects resistant to Bt, at 24 hr and 48 hr after exposure to Bt proteins or Non-ICK CRIP or their combinations.
Figure 22:
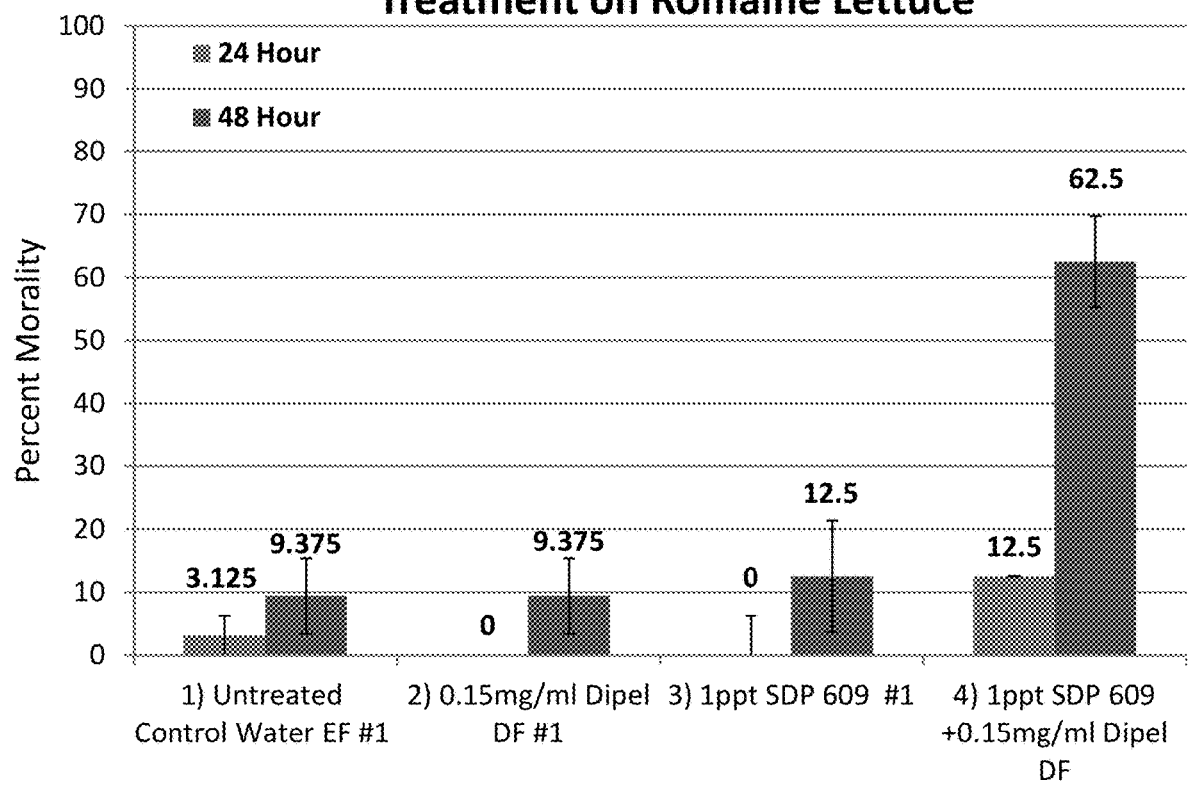
FIG. 22 Graph of a foliar feeding bioassay measuring percent mortality at 24 and 48 hour post application using Bt proteins or ICK peptides or their combination on Bt protein resistant P. xylostella larvae.

FIG. 19 shows the percent mortality results of four experiments recorded for each experiment at 18, 24, 40 and 48 hours. The non-spray dried control treatment showed the lowest average mortality of any treatments. The majority of insect mortality is observed at the 18 hour scoring and additional mortality is observed at 40 and 48 hours shown by the 40 and 48 hour scoring. Healthy insects have noticeable green, chlorophyll like color, fast evasion response when prodded with paint brush and average growth for 48 hours. Percent mortality results of 72 and 96 hour larvae are significantly reduced compared to the 24 and 48 hour old larvae. Clearly, both Bt protein and Hybrid peptide treatments alone are ineffective in controlling older insects.

Example 2

Foliar Bioassay using SDP 1234605 against *Spodoptera exigua* on Mud Lakes Farms Romaine Lettuce.

Purpose: The purpose of this experiment is designed to determine the percent mortality which occurs against *S. exigua* when SDP 1234605 is sprayed against 72 hour old larvae in a foliar leaf disk bioassay and when DIPEL® DF is co-sprayed with SDP 1234605.

Assay Preparation and Treatment Formulation: See preparation in Example 1. *S. exigua* eggs were received from Benzon Research. Petri dishes were covered and randomized before ~7-9 freshly hatched neonates *S. exigua* were applied to each leaf disk using a #0 fine haired brush by obtaining a white board and emptying a container of 72 hr old larvae onto it. Plates were sealed with parafilm and placed randomly on the rack for statistical purposes at 27° C. The assay was scored over the following day at 18, 24 and 48 hours by observing mortality and noting any differences between untreated and treated leaves.

FIG. 20 shows a column graph Example 2 data at 18, 24 and 48 hours. Individually 10 parts per thousand (ppt) of Hybrid peptide in formulation '605 and DIPEL® at 300 parts per million (ppm) show little improvement over either the untreated control or surfactant mortalities. However, when combined the resultant mortality at 48 hours of 84.4% surprisingly exceeds that which would be expected from the additive effects of the individual treatments (29.1%). The synergy of the individual components is at least 2.9 fold (84.4/29.1). It is unexpected that an insecticidal protein that kills through sepsis would be synergistic with an insecticidal peptide that modulates ion channels in the CNS.

Example 3

We investigated the potential additive and/or synergistic affects of combinations of *Bacillus thuringiensis* (Bt) proteins and the Av2 peptide from sea anemones. We used the Bt product: DIPEL® DF which is commercially available and commercially available Av2 a toxic sea anemone peptide.

Methods: Small leaf disks (~2 cm) were cut into the inner leaves of cabbage purchased from a local grocery store. Disks were dipped into 400 μL of treatment and placed on 4.25 cm #4 filter disks (Whatman) in the bottom of ~4.5 cm condiment cups. Four disks were prepared per treatment. 75 μL of water was applied to a second smaller 3.2 cm #1 filter disk (Whatman) atop the larger filter disk. Leaf disks were allowed to dry approximately ten minutes before adding four 120 hr old CryTa resistant *Plutella xylostella* per leaf disk. Condiment cups were sealed with non-perforated lids. Treatments were placed in the incubator and scored for mortality and feeding damage at 24 and 48 hrs. Due to large consumption of leaf disks in many treatments, an additional 3.2 cm untreated leaf disk was added at 24 hr to ensure larval starvation did not occur.

At 24 and 48 hrs, pictures of leaf disks were taken using an Iphone 4S (Apple Inc.), and saved. Individual leaf disk photos were cropped from the group treatment photo and assigned random numbers. Using the program Image J, leaf area eaten was calculated. The image was opened in image J and the scale in the photo was set. To set the scale, a known distance in the photo in centimeters (cm) was drawn using the segment line tool and measured in units of pixels. For this experiment, the known diameter of filter paper disk is 1.5 cm for #1 filter disk and 4.5 cm for the #4 Whatman Filter disk. Using this known length in cm, pixel units are converted in the image to centimeters. Once the scale is set, a freehand selection tool is used to draw around the area where leaf tissue remains. This process was repeated for all photos being sure to log area calculated by image J in the lab notebook. For this experiment the control area of uneaten leaf disk is 2.54 $cm^2$ and calculations were made to determine % area eaten.

Treatments:

150 PPM DIPEL® DF: 200 μL 300 PPM DIPEL® DF+200 μL water

1 PPT Av2: 0.1 mg Av2 in 100 μL water (combined four vials 1 PPT Av2 for necessary 400 μL treatments)

150 PPM DIPEL® DF+1PPT Av2: 100 μL 150 PPM DIPEL® DF was added to 0.1 mg Av2 (four vials were combined for necessary 400 μL treatment)

FIG. 21 shows the percent feeding damage resulting from Bt protein resistant diamondback moth larvae (120 hrs old) on cabbage leaf disks. Scoring at both 24 hours and 48 hours shows significant improvement over treatment with DIPEL® alone. While these insects are resistant to Bt, they do still feed to a limited extent without mortality. The combination treatment results in significantly improved protection of the foliar material. Further, treatment with Av2 alone has no effect on feeding damage and it is only in combination with the Bt protein that its effect is made apparent. This is consistent with increased bioavailability of Av2 made possible by the Bt protein.

Example 4

Foliar Bioassay using SDP 1234609 and DIPEL® DF against Earthbound Farms Romaine Lettuce.

Purpose: The purpose of this experiment is to determine the percent mortality which occurs against Bt resistant (HD-1) *P. xylostella* when SDP 1234609 is sprayed against 120 hour old larvae in a foliar leaf disk bioassay and when DIPEL® DF is co-sprayed with SDP 1234609.

Assay Preparation and Treatment Formulation: See preparation in Example 1.

FIG. 22 shows a column graph Example 4 data at 24 and 48 hours. Individually 1 parts per thousand (ppt) of Hybrid peptide in formulation '609 and DIPEL® at 150 parts per million (ppm) show little improvement over either the untreated control or surfactant mortalities. However, when combined the resultant mortality at 48 hours of 62.5% surprisingly exceeds that which would be expected from the additive effects of the individual treatments (21.8%). The synergy of the individual components is at least 2.86 fold (62.5/21.8). Again, it is unexpected that an insecticidal protein that kills through sepsis would be synergistic with an insecticidal peptide that modulates ion channels in the CNS.

SEQUENCE LISTING (1593 sequences)

SEQ ID NO: 1 - protein, 4 aa, Pisum sativum
IGER

SEQ ID NO: 2 - protein, 5 aa, Nicotiana attenuata
EEKKN

SEQ ID NO: 3 - protein, 8 aa, Nicotiana tabacum
ETMFKHGL

SEQ ID NO: 4 - protein, 24 aa, Hordeum vulgare
MANKHLSLSLFLVLLGLSASLASG

SEQ ID NO: 5 - protein, 41 aa, Hadronyche versuta
GSQYCVPVDQPCSLNTQPCCDDATCTQERNENGHTVYYCRA

SEQ ID NO: 6 - protein, 39 aa, Hadronyche versuta
QYCVPVDQPCSLNTQPCCDDATCTQELNENANPVYYCRA

SEQ ID NO: 7 - protein, 238 aa, Aequorea victoria
ASKGEELFTGVVPILVELDGDVNGHKFSVSGEGEGDATYGKLTLKFICTTGKLPVPWPTLVTTFSYGVQCFSRYPDHMKRHDFFKSAMPEGYVQERTISFKDDGNYKTRAEVKFEGDTLVNRIELKGIDFKEDGNILGHKLEYNYNSHNVYITADKQKNGIKANFKIRHNIEDGSVQLADHYQQNTPIGDGPVLLPDNHYLSTQSALSKDPNEKRDHMVLLEFVTAAGITHGMDELYK

SEQ ID NO: 8 - protein, 38 aa, Hadronyche versuta
MSPTCIPSGQPCPYNENCCSQSCTFKENENGNTVKRCD

SEQ ID NO: 9 - protein, 61 aa, Hadronyche versuta
MANKHLSLSLFLVLLGLSASLASGSPTCIPSGQPCPYNENCCSQSCTFKENENGNTVKRCD

SEQ ID NO: 10 - protein, 282 aa, Hadronyche versuta
MASKGEELFTGVVPILVELDGDVNGHKFSVSGEGEGDATYGKLTLKFICTTGKLPVPWPTLVTTFSYGVQCFSRYPDHMKRHDFFKSAMPEGYVQERTISFKDDGNYKTRAEVKFEGDTLVNRIELKGIDFKEDGNILGHKLEYNYNSHNVYITADKQKNGIKANFKIRHNIEDGSVQLADHYQQNTPIGDGPVLLPDNHYLSTQSALSKDPNEKRDHMVLLEFVTAAGITHGMDELYKIGERQYCVPVDQPCSLNTQPCCDDATCTQERNENGHTVYYCRA

SEQ ID NO: 11 - protein, 305 aa, Hadronyche versuta
MANKHLSLSLFLVLLGLSASLASGASKGEELFTGVVPILVELDGDVNGHKFSVSGEGEGDATYGKLTLKFICTTGKLPVPWPTLVTTFSYGVQCFSRYPDHMKRHDFFKSAMPEGYVQERTISFKDDGNYKTRAEVKFEGDTLVNRIELKGIDFKEDGNILGHKLEYNYNSHNVYITADKQKNGIKANFKIRHNIEDGSVQLADHYQQNTPIGDGPVLLPDNHYLSTQSALSKDPNEKRDHMVLLEFVTAAGITHGMDELYKIGERQYCVPVDQPCSLNTQPCCDDATCTQERNENGHTVYYCRA

SEQ ID NO: 12 - protein, 39 aa, Hadronyche versuta
QYCVPVDQPCSLNTQPCCDDATCTQERNENGHTVYYCRA

SEQ ID NO: 13 - protein, 239 aa, Aequorea victoria
MASKGEELFTGVVPILVELDGDVNGHKFSVSGEGEGDATYGKLTLKFICTTGKLPVPWPTLVTTFSYGVQCFSRYPDHMKRHDFFKSAMPEGYVQERTISFKDDGNYKTRAEVKFEGDTLVNRIELKGIDFKEDGNILGHKLEYNYNSHNVYITADKQKNGIKANFKIRHNIEDGSVQLADHYQQNTPIGDGPVLLPDNHYLSTQSALSKDPNEKRDHMVLLEFVTAAGITHGMDELYK

SEQ ID NO: 14 - DNA, 932 bp, Agrobacterium tumefaciens
  source 1..932: mol_type = genomic DNA
ttaattaaatggctaataaacacctgagtttgtcactattcctcgtgttgctcgggttatctgcttcacttgcaagcggagctagcaaaggagaagaacttttcactggagttgtcccaattcttgttgaattagatggtgatgttaatgggcacaaattttctgtcagtggagagggtgaaggtgatgctacatacggaaagcttacccttaaatttatttgcactactggaaaactacctgttccatggccaacacttgtcactactttctcttatggtgttcaatgcttttcccgttatccggatcatatgaaacggcatgactttttcaagagtgccatgcccgaaggttatgtacaggaacgcactatatctttcaaagatgacgggaactacaagacgcgtgctgaagtcaagtttgaaggtgatacccttgttaatcgtatcgagttaaaaggtattgattttaaagaagatggaaacattctcggacacaaactcgagtacaactataactcacacaatgtatacatcacggcagacaaacaaaagaatggaatcaaagctaacttcaaaattcgccacaacattgaagatggatccgttcaactagcagaccattatcaacaaaatactccaattggcgatggccctgtccttttaccagacaaccattacctgtcgacacaatctgccctttcgaaagatcccaacgaaaagcgtgaccacatggtccttcttgagtttgtaactgctgctgggattacacatggcatggatgagctctacaaaattggtgaaagacaatattgtgttccagttgatcaaccatgttctcttaatactcaaccatgttgtgatgatgctacttgtactcaagaaagaaatgaaaatggacatactgtttattattgtagagcttaacctagg

SEQ ID NO: 15 - DNA, 849 bp, Nicotiana benthamiana
  source 1..849: mol_type = genomic DNA
atggctagcaaaggagaagaacttttcactggagttgtcccaattcttgttgaattagatggtgatgttaatgggcacaaattttctgtcagtggagagggtgaaggtgatgctacatacggaaagcttacccttaaatttatttgcactactggaaaactacctgttccatggccaacacttgtcactactttctcttatggtgttcaatgcttttcccgttatccggatcatatgaaacggcatgactttttcaagagtgccatgcccgaaggttatgtacaggaacgcactatatctttcaaagatgacgggaactacaagacgcgtgctgaagtcaagtttgaaggtgatacccttgttaatcgtatcgagttaaaaggtattgattttaaagaagatggaaacattctcggacacaaactcgagtacaactataactcacacaatgtatacatcacggcagacaaacaaaagaatggaatcaaagctaacttcaaaattcgccacaacattgaagatggatccgttcaactagcagaccattatcaacaaaatactccaattggcgatggccctgtccttttaccagacaaccattacctgtcgacacaatctgccctttcgaaagatcccaacgaaaagcgtgaccacatggtccttcttgagtttgtaactgctgctgggattacacatggcatggatgagctctacaaaattggtgaaagacaatattgtgttccagttgatcaaccatgttctcttaatactcaaccatgttgtgatgatgctacttgtactcaagaaagaaatgaaaatggacatactgtttattattgtagagcttaa

SEQ ID NO: 16 - protein, 4 aa, Nicotiana benthamiana
KDEL

SEQ ID NO: 17 - DNA, 930 bp, Nicotiana benthamiana
  source 1..930: mol_type = genomic DNA
atggctaataaacacctgagtttgtcactattcctcgtgttgctcgggttatctgcttcacttgcaagcggagctagcaaaggagaagaacttttcactggagttgtcccaattcttgttgaattagatggtgatgttaatgggcacaaattttctgtcagtggagagggtgaaggtgatgctacatacggaaagcttacccttaaatttatttgcactactggaaaactacctgttccatggccaacacttgtcactactttctcttatggtgttcaatgcttttcccgttatccggatcatatgaaacggcatgactttttcaagagtgccatgcccgaaggttatgtacaggaacgcactatatctttcaaagatgacgggaactacaagacgcgtgctgaagtcaagtttgaaggtgatacccttgttaatcgtatcgagttaaaaggtattgattttaaagaagatggaaacattctcggacacaaactcgagtacaactataactcacacaatgtatacatcacggcagacaaacaaaagaatggaatcaaagctaacttcaaaattcgccacaacattgaagatggatccgttcaactagcagaccattatcaacaaaatactccaattggcgatggccctgtccttttaccagacaaccattacctgtcgacacaatctgccctttcgaaagatcccaacgaaaagcgtgaccacatggtccttcttgagtttgtaactgctgctgggattacacatggcatggatgagctctacaaaattggtgaaagacaatattgtgttccagttgatcaaccatgttctattaatactcaaccatgttgtgatgatgctacttgtactcaagaaagaaatgaaaatggacatactgtttattattgtagagctaaagatgagctctaa

SEQ ID NO: 18 - protein, 26 aa, Nicotiana benthamiana
MGKMASLFASLLVVLVSLSLASESSA

SEQ ID NO: 19 - protein, 26 aa, Nicotiana benthamiana
MGKMASLFATFLVVLVSLSLASESSA

SEQ ID NO: 20 - DNA, 78 bp, Nicotiana benthamiana
  source 1..78: mol_type = genomic DNA
atgggtaagatggcttctctgtttgcttctctgctggttgttctggtttctctgtctctggcttctgaatcttctgct

SEQ ID NO: 21 - DNA, 938 bp, Nicotiana benthamiana
  source 1..938: mol_type = genomic DNA
ttaattaaatgggtaagatggcttctctgtttgcttctctgctggttgttctggtttctctgtctctggcttctgaatcttctgctgctagcaaaggagaagaacttttcactggagttgtcccaattcttgttgaattagatggtgatgttaatgggcacaaattttctgtcagtggagagggtgaaggtgatgctacatacggaaagcttacccttaaatttatttgcactactggaaaactacctgttccatggccaacacttgtcactactttctcttatggtgttcaatgcttttcccgttatccggatcatatgaaacggcatgactttttcaagagtgccatgcccgaaggttatgtacaggaacgcactatatctttcaaagatgacgggaactacaagacgcgtgctgaagtcaagtttgaaggtgatacccttgttaatcgtatcgagttaaaaggtattgattttaaagaagatggaaacattctcggacacaaactcgagtacaactataactcacacaatgtatacatcacggcagacaaacaaaagaatggaatcaaagctaacttcaaaattcgccacaacattgaagatggatccgttcaactagcagaccattatcaacaaaatactccaattggcgatggccctgtccttttaccagacaaccattacctgtcgacacaatctgccctttcgaaagatcccaacgaaaagcgtgaccacatggtccttcttgagtttgtaactgctgctgggattacacatggcatggatgagctctacaaaattggtgaaagacaatattgtgttccagttgatcaaccatgttctcttaatactcaaccatgttgtgatgatgctacttgtactcaagaaagaaatgaaaatggacatactgtttattattgtagagcttaacctagg

SEQ ID NO: 22 - DNA, 78 bp, Nicotiana benthamiana
  source 1..78: mol_type = genomic DNA
atgggtaagatggcttctctgtttgctacttttctggttgttctggtttctctgtctctggcttctgaatcttctgct

SEQ ID NO: 23 - DNA, 938 bp, Nicotiana benthamiana
  source 1..938: mol_type = genomic DNA
ttaattaaatgggtaagatggcttctctgtttgctacttttctggttgttctggtttctctgtctctggcttctgaatcttctgctgctagcaaaggagaagaacttttcactggagttgtcccaattcttgttgaattagatggtgatgttaatgggcacaaattttctgtcagtggagagggtgaaggtgatgctacatacggaaagcttacccttaaatttatttgcactactggaaaactacctgttccatggccaacacttgtcactactttctcttatggtgttcaatgcttttcccgttatccggatcatatgaaacggcatgactttttcaagagtgccatgcccgaaggttatgtacaggaacgcactatatctttcaaagatgacgggaactacaagacgcgtgctgaagtcaagtttgaaggtgatacccttgttaatcgtatcgagttaaaaggtattgattttaaagaagatggaaacattctcggacacaaactcgagtacaactataactcacacaatgtatacatcacggcagacaaacaaaagaatggaatcaaagctaacttcaaaattcgccacaacattgaagatggatccgttcaactagcagaccattatcaacaaaatactccaattggcgatggccctgtccttttaccagacaaccattacctgtcgacacaatctgccctttcgaaagatcccaacgaaaagcgtgaccacatggtccttcttgagtttgtaactgctgctgggattacacatggcatggatgagctctacaaaattggtgaaagacaatattgtgttccagttgatcaaccatgttctcttaatactcaaccatgttgtgatgatgctacttgtactcaagaaagaaatgaaaatggacatactgtttattattgtagagcttaacctagg

SEQ ID NO: 24 - protein, 37 aa, Hadronyche versuta
SPTCIPSGQPCPYNENCCSQSCTFKENENGNTVKRCD

SEQ ID NO: 25 - protein, 224 aa, Juniperus ashei
MARVSELAFLLAATLAISLHMQEAGVVKFDIKNQCGYTVWAAGLPGGGKRLDQGQTWTVNLAAGTASARFWGRTGCTFDASGKGSCQTGDCGGQLSCTVSGAVPATLAEYTQSDQDYYDVSLVDGFNIPLAINPTNAQCTAPACKADINAVCPSELKVDGGCNSACNVFKTDQYCCRNAYVDNCPATNYSKIFKNQCPQAYSYAKDDTATFACASGTDYSIVFC

SEQ ID NO: 26 - protein, 197 aa, Juniperus ashei
KFDIKNQCGYTVWAAGLPGGGKRLDQGQTWTVNLAAGTASARFWGRTGCTFDASGKGSCQTGDCGGQLSCTVSGAVPATLAEYTQSDQDYYDVSLVDGFNIPLAINPTNAQCTAPACKADINAVCPSELKVDGGCNSACNVFKTDQYCCRNAYVDNCPATNYSKIFKNQCPQAYSYAKDDTATFACASGTDYSIVFC

SEQ ID NO: 27 - protein, 27 aa, Juniperus ashei
MARVSELAFLLAATLAISLHMQEAGVV

SEQ ID NO: 28 - protein, 105 aa, Galanthus nivalis
DNILYSGETLSTGEFLNYGSFVFIMQEDCNLVLYDVDKPIWATNTGGLSRSCFLSMQTDGNLVVYNPSNKPIWASNTGGQNGNYVCILQKDRNVVIYGTDRWATG

SEQ ID NO: 29 - protein, 29 aa, Kluyveromyces lactis
GSRSCCPCYWGGCPWGQNCYPEGCSGPKV

SEQ ID NO: 30 - protein, 27 aa, Kluyveromyces lactis
RSCCPCYWGGCPWGQNCYPEGCSGPKV

SEQ ID NO: 31 - DNA, 366 bp, Hordeum vulgare
  source 1..366: mol_type = genomic DNA
aagcttgaaaaaaatgaaattttccactattttagcagcatctacagctttaatcagtgttgtcatggctgcacctgtgagtaccgaaacagatatagacgaccttccaatctctgttccagaagaggctttgataggattcatcgatttgactggtgatgaagtttcattgttaccagtgaataatggtacccatactggtattttgttcctaaacaccacaattgctgaagctgcttttgcagataaggatgatttggagaaaagaggttctagatcatgctgcccttgttactggggtggttgtccatggggacaaaactgttatcctgaaggatgttctggtccaaaggtatgagcggccgc

SEQ ID NO: 32 - DNA, 360 bp, Anemonia viridis
  source 1..360: mol_type = genomic DNA
aagcttgaaaaaaatgaaattttccacaatcttagctgcaagtactgctcttatttctgttgtgatggctgctccagtatctaccgaaacagatatcgatgatttgccaatttcagtccctgaagaggcactaatcggattcattgacttaaccggtgatgaagtgagtttgttgccagttaacaacggtactcatacaggtatattgtttttgaataccactatagctgaagcagcattcgctgataaagatgacttagaaaagagaagatcatgctgcccttgttactggggtggttgtccatggggtcaaaattgttatccagagggttgttctggacctaaggtttgagcggccgc

SEQ ID NO: 33 - protein, 675 aa, Bacillus thuringiensis israelensis
MNPYQNKNEYEIFNAPSNGFSKSNNYSRYPLANKPNQPLKNTNYKDWLNVCQDNQQYGNNAGNFASSETIVGVSAGIIVVGTMLGAFAAPVLAAGIISFGTLLPIFWQGSDPANVWQDLLNIGGRPIQEIDKNIINVLTSIVTPIKNQLDKYQEFFDKWEPARTHANAKAVHDLFTTLEPIIDKDLDMLKNNASYRIPTLPAYAQIATWHLNLLKHAATYYNIWLQNQGINPSTFNSSNYYQGYLKRKIQEYTDYCIQTYNAGLTMIRTNTNATWNMYNTYRLEMTLTVLDLIAIFPNYDPEKYPIGVKSELIREVYTNVNSDTFRTITELENGLTRNPTLFTWINQGRFYTRNSRDILDPYDIFSFTGNQMAFTHTNDDRNIIWGAVHGNIISQDTSKVFPFYRNKPIDKVEIVRHREYSDIIYEMIFFSNSSEVFRYSSNSTIENNYKRTDSYMIPKQTWKNEEYGHTLSYIKTDNYIFSVVRERRRVAFSWTHTSVDFQNTIDLDNITQIHALKALKVSSDSKIVKGPGHTGGDLVILKDSMDFRVRFLKNVSRQYQVRIRYATNAPKTTVFLTGIDTISVELPSTTSRQNPNATDLTYADFGYVTFPRTVPNKTFEGEDTLLMTLYGTPNHSYNIYIDKIEFIPITQSVLDYTEKQNIEKTQKIVNDLFVN

SEQ ID NO: 34 - protein, 675 aa, Bacillus thuringiensis israelensis
MNPYQNKNEYEIFNAPSNGFSKSNNYSRYPLANKPNQPLKNTNYKDWLNVCQDNQQYGNNAGNFASSETIVGVSAGIIVVGTMLGAFAAPVLAAGIISFGTLLPIFWQGSDPANVWQDLLNIGGRPIQEIDKNIINVLTSIVTPIKNQLDKYQEFFDKWEPARTHANAKAVHDLFTTLEPIIDKDLDMLKNNASYRIPTLPAYAQIATWHLNLLKHAATYYNIWLQNQGINPSTFNSSNYYQGYLKRKIQEYTDYCIQTYNAGLTMIRTNTNATWNMYNTYRLEMTLTVLDLIAIFPNYDPEKYPIGVKSELIREVYTNVNSDTFRTITELENGLTRNPTLFTWINQGRFYTRNSRDILDPYDIFSFTGNQMAFTHTNDDRNIIWGAVHGNIISQDTSKVFPFYRNKPIDKVEIVRHREYSDIIYEMIFFSNSSEVFRYSSNSTIENNYKRTDSYMIPKQTWKNKEYGHTLSYIKTDNYIFSVVRERRRVAFSWTHTSVDFQNTIDLDNITQIHALKALKVSSDSKIVKGPGHTGGDLVILKDSMDFRVRFLKNVSRQYQVRIRYATNAPKTTVFLTGIDTISVELPSTTSRQNPNATDLTYADFGYVTFPRTVPNKTFEGEDTLLMTLYGTPNHSYNIYIDKIEFIPITQSVLDYTEKQNIEKTQKIVNDLFVN

SEQ ID NO: 35 - protein, 675 aa, Bacillus thuringiensis s. israelensis BRC-LLP29; identical to SEQ ID NO: 34

SEQ ID NO: 36 - protein, 643 aa, Bacillus thuringiensis israelensis
MEDSSLDTLSIVNETDFPLYNNYTEPTIAPALIAVAPIAQYLATAIGKWAAKAAFSKVLSLIFPGSQPATMEKVRTEVETLINQKLSQDRVNILNAEYRGIIEVSDVFDAYIKQPGFTPATAKGYFLNLSGAIIQRLPQFEVQTYEGVSIALFTQMCTLHLTLLKDGILAGSAWGFTQADVDSFIKLFNQKVLDYRTRLMRMYTEEFGRLCKVSLKDGLTFRNMCNLYVFPFAEAWSLMRYEGLKLQSSLSLWDYVGVSIPVNYNEWGGLVYKLLMGEVNQRLTTVKFNYSFTNEPADIPARENIRGVHPIYDPSSGLTGWIGNGRTNNFNFADNNGNEIMEVRTQTFYQNPNNEPIAPRDIINQILTAPAPADLFFKNADINVKFTQWFQSTLYGWNIKLGTQTVLSSRTGTIPPNYLAYDGYYIRAISACPRGVSLAYNHDLTTLTYNRIEYDSPTTENIIVGFAPDNTKDFYSKKSHYLSETNDSYVIPALQFAEVSDRSFLEDTPDQATDGSIKFARTFISNEAKYSIRLNTGFNTATRYKLIIRVRVPYRLPAGIRVQSQNSGNNRMLGSFTANANPEWVDFVTDAFTFNDLGITTSSTNALFSISSDSLNSGEEWYLSQLFLVKESAFTTQINPLLK

SEQ ID NO: 37 - protein, 78 aa, Bacillus thuringiensis israelensis
NSGNNRMLGSFTANANPEWVDFVTDAFTFNDLGITTSSTNALFSISSDSLNSGEEWYLSQLFLVKESAFTTQINPLLK

SEQ ID NO: 38 - protein, 643 aa, Bacillus thuringiensis israelensis; identical to SEQ ID NO: 36

SEQ ID NO: 39 - protein, 643 aa, Bacillus thuringiensis s. israelensis BRC-LLP29
MNYMEDSSLDTLSIVNETDFPLYNNYTEPTIAPALIAVAPIAQYLATAIGKWAAKAAFSKVLSLIFPGSQPATMEKVRTEVETLINQKLSQDRVNILNAEYRGIIEVSDVFDAYIKQPGFTPATAKGYFLNLSGAIIQRLPQFEVQTYEGVSIALFTQMCTLHLTLLKDGILAGSAWGFTQADVDSFIKLFNQKVLDYRTRLMRMYTEEFGRLCKVSLKDGLTFRNMCNLYVFPFAEAWSLMRYEGLKLQSSLSLWDYVGVSIPVNYNEWGGLVYKLLMGEVNQRLTTVKFNYSFTNEPADIPARENIRGVHPIYDPSSGLTGWIGNGRTNNFNFADNNGNEIMEVRTQTFYQNPNNEPIAPRDIINQILTAPAPADLFFKNADINVKFTQWFQSTLYGWNIKLGTQTVLSSRTGTIPPNYLAYDGYYIRAISACPRGVSLAYNHDLTTLTYNRIEYDSPTTENIIVGFAPDNTKDFYSKKSHYLSETNDSYVIPALQFAEVSDRSFLEDTPDQATDGSIKFARTFISNEAKYSIRLNTGFNTATRYKLIIRVRVPYRLPAGIRVQSQNSGNNRMLGSFTANANPEWVDFVTDAFTFNDLGITTSSTNALFSISSDSLNSGEEWYLSQLFLVKESAFTTQINP

SEQ ID NO: 40 - protein, 724 aa, Bacillus thuringiensis jegathesan 367
MQNNNFNTTEINNMINFPMYNGRLEPSLAPALIAVAPIAKYLATALAKWAVKQGFAKLKSEIFPGNTPATMDKVRIEVQTLLDQRLQDDRVKILEGEYKGIIDVSKVFTDYVNQSKFETGTANRLFFDTSNQLISRLPQFEIAGYEGVSISLFTQMCTFHLGLLKDGILAGSDWGFAPADKDALICQFNRFVNEYNTRLMVLYSKEFGRLLAKNLNEALNFRNMCSLYVFPFSEAWSLLRYEGTKLENTLSLWNFVGESINNISPNDWKGALYKLLMGAPNQRLNNVKFNYSYFSDTQATIHRENIHGVLPTYNGGPTITGWIGNGRFSGLSFPCSNELEITKIKQEITYNDKGGNFNSIVPAATRNEILTATVPTSADPFFKTADINWKYFSPGLYSGWNIKFDDTVTLKSRVPSIIPSNILKYDDYYIRAVSACPKGVSLAYNHDFLTLTYNKLEYDAPTTQNIIVGFSPDNTKSFYRSNSHYLSTTDDAYVIPALQFSTVSDRSFLEDTPDQATDGSIKFTDTVLGNEAKYSIRLNTGFNTATRYRLIIRFKAPARLAAGIRVRSQNSGNNKLLGGIPVEGNSGWIDYITDSFTFDDLGITTSSTNAFFSIDSDGVNASQQWYLSKLILVKESSFTTQIPLKPYVIVRCPDTFFVSNNSSSTYEQGYNNNYNQNSSSMYDQGYNNSYNPNSGCTCNQDYNNSYNQNSGCTCNQGYNNNYPK

SEQ ID NO: 41 - protein, 750 aa, Bacillus thuringiensis medellin
MENNSFNVLANNNMSSFPLFNSKIEPSIAPALIAVAPIAKYLATALAKWALKQGFAKLKSEIFPGNETATMEKVRLEVQTILNQTLQTDRVATLKAEYEGFIHLGKVFTDYVSQSTFTPATAKTHFLNMSNLLIQRLPQFEIAGYEGVSISLFTQMCTLHLGLLKDGILAGSDWGFTPEDKDSLICQFNRYVNEYNTRMMGLYSIEFGRLLAKNLNEALNFRNMCSLYVFPFSEAWYLLRYEGTKLENTLSLWNFVGEDIGGILHNDWKGALYKLLMGATNQRLANVRFNYSYFSDTQGTIHRENILGAHPTYNGEQTPTGWIGNGRLGRFSAPYSNELEITKVEQEITYNNKGDHSNSIVPANTRNEILTATVPITADPFFKTADINWRYFSQGLYYGWNIKFDDRVILNSRVPGGIPSNRLEYDGYYIRAVSACPRNVPLSYNHNYLTLTYNRLEYDAPTTQNIIVGFSPNNTKSFYARNSHYLSATNDAYVIPALQFATVSDRSFLEDTPDQATDGSIKFTETVLGNEAKYSIRLNTGFNTATRYRLVIRFKATARLAAGIRVRSQNSGNNRLLGGIPVEGNSGWVDYITDSFTFNDLGITTASTNAFFSIDSDGVNASQQWYLSKLILVKDFVNNSGFRNQVPLAPYVIARCPNTFFVSNNTSSGYEQGYNDNYNQNTSSGYEQGYNDNYNQNTSSGYEQGYNDNYNQNTSSGYEQGYNDNYNQNTSSGYEQGYNDNYNQNTSSGV

SEQ ID NO: 42 - protein, 792 aa, Bacillus thuringiensis K34
MENNSFNVLANNNMSSFPLFNSKIEPSIAPALIAVAPIAKYLATALAKWALKQGFAKLKSEIFPGNTPATMEKVRLEVQTLLNQTLQADRVAILNAEYQGFINLGKIFTDYVSQSTFTPATAKTHFLSMSNQLIQRLPQFEIAGYEGVSISLFTQMCTLHLGLLKDGILAGSDWGFTPEDKDSLICQFNRYVNEYNTRMMGLYSIEFGRLLAKNLNEALNFRNMCSLYVFPFSEAWYLLRYEGTKLENTLSLWNFVGEDIGGILHNDWKGALYKLLMGATNQRLANVRFNYSYFSDTQGTIHRENILGAHPTYNGEQTPTGWIGNGRLGRFSAPYSNELEITKVEQEITYNNKGDHSNSIVPANTRNEILTATVPITADPFFKTADINWRYFSQGLYYGWNIKFDDKVILNSRVPGGIPSNRLEYDGYYIRAVSACPRNVPLSYNHNYLTLTYNRLEYDAPTTQNIIVGFSPNNTKSFYARNSHYLSATDDAYVIPALQFATVSDRSFLEDTPDQATDGSIKFTETVLGNEAKYSIRLNTGFNTATRYRLVIRFKAPARLAAGIRVRSQNSGNNRLLGGIPVEGNSGWVDYITDSFTFNDLGITTASTNAFFSIDSDGVNASQQWYLSKLILVKDFVNNSGFRNQVPLAPYVITRCPNTFFVSNNTSSGYEQGYNDNYNQNTSSGYEQGYNDNYNQNTSSGYEQGYNDNYNQNTSSGYEQGYNDNYNQNTSSEYEQGYNDNYNQNTSSGYEQGYNDNYNQNTSSGYEQGYIDNYRPNTECKCGRRHNNYDHK

SEQ ID NO: 43 - protein, 1257 aa, Bacillus thuringiensis PS33F2
MATLNEVYPVNYNVLSSDAFQQLDTTGFKSKYDEMIKAFEKKWKKGAKGKDLLDVAWTYITTGEIDPLNVIKGVLSVLTLIPEVGTVASAASTIVSFIWPKIFGDKPNAKNIFEELKPQIEALIQQDITNYQDAINQKKFDSLQKTINLYTVAIDNNDYVTAKTQLENLNSILTSDISIFIPEGYETGGLPYYAMVANAHILLLRDAIVNAEKLGFSDKEVDTHKKYIKMTIHNHTEAVIKAFLNGLDKFKSLDVNSYNKKANYIKGMTEMVLDLVALWPTFDPDHYQKEVEIEFTRTISSPIYQPVPKNMQNTSSSIVPSDLFHYQGDLVKLEFSTRTDNDGLAKIFTGIRNTFYKSPNTHETYHVDFSYNTQSSGNISRGSSNPIPIDLNNPIISTCIRNSFYKAIAGSSVLVNFKDGTQGYAFAQAPTGGAWDHSFIESDGAPEGHKLNYIYTSPGDTLRDFINVYTLISTPTINELSTEKIKGFPAEKGYIKNQGIMKYYGKPEYINGAQPVNLENQQTLIFEFHASKTAQYTIRIRYASTQGTKGYFRLDNQELQTLNIPTSHNGYVTGNIGENYDLYTIGSYTITEGNHTLQIQHNDKNGMVLDRIEFVPKDSLQDSPQDSPPEVHESTIIFDKSSPTIWSSNKHSYSHIHLEGSYTSQGSYPHNLLINLFHPTDPNRNHTIHVNNGDMNVDYGKDSVADGLNFNKITATIPSDAWYSGTITSMHLFNDNNFKTITPKFELSNELENITTQVNALFASSAQDTLASNVSDYWIEQVVMKVDALSDEVFGKEKKALRKLVNQAKRLSKIRNLLIGGNFDNLVAWYMGKDVVKESDHELFKSDHVLLPPPTFHPSYIFQKVEESKLKPNTRYTISGFIAHGEDVELVVSRYGQEIQKVMQVPYEEALPLTSESNSSCCVPNLNINETLADPHFFSYSIDVGSLEMEANPGIEFGLRIVKPTGMARVSNLEIREDRPLTAKEIRQVQRAARDWKQNYEQERTEITAIIQPVLNQINALYENEDWNGSIRSNVSYHDLEQIMLPTLLKTEEINCNYDHPAFLLKVYHWFMTDRIGEHGTILARFQEALDRAYTQLESRNLLHNGHFTTDTANWTIEGDAHHTILEDGRRVLRLPDWSSNATQTIEIEDFDLDQEYQLLIHAKGKGSITLQHGEENEYVETHTHHTNDFITSQNIPFTFKGNQIEVHITSEDGEFLIDHITVIEVSKTDTNTNIIENSPINTSMNSNVRVDIPRSL

SEQ ID NO: 44 - protein, 803 aa, Bacillus thuringiensis PS63B
MTCQLQAQPLIPYNVLAGVPTSNTGSPIGNAGNQFDQFEQTVKELKEAWEAFQKNGSFSLAALEKGFDAAIGGGSFDYLGLVQAGLGLVGTLGAAIPGVSVAVPLISMLVGVFWPKGTNNQENLITVIDKEVQRILDEKLSDQLIKKLNADLNAFTDLVTRLEEVIIDATFENHKPVLQVSKSNYMKVDSAYFSTGGILTLGMSDFLTDTYSKLTFPLYVLGATMKLSAYHSYIQFGNTWLNKVYDLSSDEGKTMSQALARAKQHMRQDIAFYTSQALNMFTGNLPSLSSNKYAINDYNVYTRAMVLNGLDIVATWPTLYPDDYSSQIKLEKTRVIFSDMVGQSESRDGSVTIKNIFDNTDSHQHGSIGLNSISYFPDELQKAQLRMYDYNHKPYCTDCFCWPYGVILNYNKNTFRYGDNDPGLSGDVQLPAPMSVVNAQTQTAQYTDGENIWTDTGRSWLCTLRGYCTTNCFPGRGCYNNSTGYGESCNQSLPGQKIHALYPFTQTNVLGQSGKLGLLASHIPYDLSPNNTIGDKDTDSTNIVAKGIPVEKGYASSGQKVEIIREWINGANVVQLSPGQSWGMDFTNSTGGQYMVRCRYASTNDTPIFFNLVYDGGSNPIYNQMTFPATKETPAHDSVDNKILGIKGINGNYSLMNVKDSVELPSGKFHVFFTNNGSSAIYLDRLEFVPLDQPAAPTQSTQPINYPITSRLPHRSGEPPAIIWEKSGNVRGNQLTISAQGVPENSQIYLSVGGDRQILDRSNGFKLVNYSPTYSFTNIQASSSNLVDITSGTITGQVQVSNL

SEQ ID NO: 45 - protein, 1186 aa, Bacillus thuringiensis sotto PS80JJ1
MDCNLQSQQNIPYNVLAIPVSNVNALVDTAGDLKKAWEEFQKTGSFSLTALQQGFSASQGGAFNYLTLLQSGISLAGSFVPGGTFVAPIVNMVIGWLWPHKNKTADTENLIKLIDEEIQKQLNKALLDQDRNNWTSFLESIFDTSATVSNAIIDAQWSGTVDTTNRQQKTPTTSDYLNVVGKFDSADSSIITNENQIMNGNFDVAAAPYFVIGATLRLSLYQSYIKFCNSWIDAVGFSTNDANTQKANLARTKLTMRTTINEYTQRVMKVFKDSKNMPTIGTNKFSVDAYNVYVKGMTLNVLDMVAIWSSLYPNDYTSQTAIEQTRVTFSNMVGQEEGTDGTLKIYNTFDSLSYQHSLIPNNNVNLISYYTDELQNLELAVYTPKGGSGYAYPYGFILNYANSNYKYGDNDPTGKPLNKQDGPIQQINAATQNSKYLDGETINGIGASLPGYCTTGCSATEQPFSCTSTANSYKASCNPSDTNQKINALYAFTQTNVKGSTGKLGVLASLVPYDLNPKNVFGELDSDTNNVILKGIPAEKGYFPNNARPTVVKEWINGASAVPFYSGNTLFMTATNLTATQYKIRIRYANPNSDTQIGVLITQNGSQISNSNLTLYSTTDSSMSSNLPQNVYVTGENGNYTLLDLYSTTNVLSTGDITLKLTGGNQKIFIDRIEFIPTMPVPAPTNNTNNNNGDNGNNNPPHHGCAIAGTQQLCSGPPKFEQVSDLEKITTQVYMLFKSSSYEELALKVSSYQINQVALKVMALSDEKFCEEKRLLRKLVNKANQLLEARNLLVGGNFETTQNWVLGTNAYINYDSFLFNGNYLSLQPASGFFTSYAYQKIDESTLKPYTRYKVSGFIGQSNQVELIISRYGKEIDKILNVPYAGPLPITADASITCCAPEIDQCDGGQSDSHFFNYSIDVGALHPELNPGIEIGLKIVQSNGYITISNLEIIEERPLTEMEIQAVNRKDQKWKREKLLECASVSELLQPIINQIDSLFKDANWYNDILPHVTYQTLKNIIVPDLPKLKHWFIDHLPGEYHEIEQKMKEALKHAFTQLDEKNLIHNGHFATNLIDWQVEGDARMKVLENNALALQLSNWDSSVSQSIDILEFDEDKAYKLRVYAQGSGTIQFGNCEDEAIQFNTNSFVYKEKIIYFDTPSINLHIQSEGSEFVVSSIDLVELSDDE

SEQ ID NO: 46 - protein, 340 aa, Bacillus thuringiensis thompsoni
MAIMNDIAQDAARAWDIIAGPFIRPGTTPTNRQLFNYQIGNIEVEPGNLNFSVVPELDFSVSQDLFNNTSVQQSQTASFNESRTETTSTAVTHGVKSGVTVSASAKFNAKILVKSIEQTITTTVSTEYNFSSTTTRTNTVTRGWSIAQPVLVPPHSRVTATLQIYKGDFTVPVLLSLRVYGQTGTLAGNPSFPSLYAATYENTLLGRIREHIAPPALFRASNAYISNGVQAIWRGTATTRVSQGLYSVVRIDERPLAGYSGETRTYYLPVTLSNSSQILTPGSLGSEIPIINPVPNASCKKENSPIIIHHDREKHRERDYDKEHICHDQAEKYERDYDKE

SEQ ID NO: 47 - protein, 613 aa, Clostridium bifermentans malaysia CH18
MNTNIFSTHLEFSKGVASVFKVIDTIHNISKNNNFNNILTQDFIIDTILSILWEDPNENEIFSSMIEDGETITNKNLSAQTKEGLLLNSNSFGLKFKYYNNAFRSWIDNYNPTSIDDVVYRFKDVNSICENNINEFKVKNYEVTVLPIYMQIANLHLLLLRDGMIYGDAWNLYRELGFSDQDSFYNHVLDKTKFYINDCLNYYNTGLSNLKLDPNNSWIDITRYCRFMTFYILDMISICPIYDTKVYDKPINMQTLTRKVYSDPVNFIDENIPISEYEKMYNISPELFSTLFSISFYTNKSGNKFLNGHVNRHVGTDLNYNGLRETHYGNYGSNYEVESMAFDDIKAYSNNYFNNTQNNNPTSVKSIKFLITKNNDEWIYGEPDSSNIDFTRNIQGYLSNLNNESYTHSLSDMILANNDKIQINIDTPHSYSYSWIYKGIEDTNYISDKLINQIPLVKEVKLKSRHYSEISVIKGPGFTGGDLILSKVHKPANQIPAQYMKNKITIPIKTKFPAGSQDFKVRLCYASNHDIGLIRLIAGSKYITTNIQQTFNTTENNPSLIYDDFKYFNFNETLSITSSGIDELYLEFYYSYTDGNFEDFPKLSIPYTRNYSC

SEQ ID NO: 48 - protein, 618 aa, Clostridium bifermentans malaysia CH18
MNNKKIEQNKIVEYNSNLDIQPRELNTLNGLVFTGATVSIILPLIGTTAVVPVVGGVIGIIAALLPVIWPAGTSSNDNLFDAVMKDTEMIMDEKISEYVVNDAMTRLESLYNILDYYRLSKDFWEKNKDDPLAIAELKERFSKLHSQFIESMAYFKRANYEVLLLPAYANAANLHLLLLREGLLLNKVIDNFITEGLHYEEFKTKRSTYIAHCSTWYNKGLENIKNKTRDFNKINKYDAYMNLSVLDIISLFLSYDPYQYDKATKLQTLTRTVFSDPLQRAPRDLYISPKEETLFKNLKGLRAFFAEGDLVLTGFRNYFRNTYINDQIIEGDLFGYTTNNERYKLFTDSKIYKVTVFIDNVALAIVKLIFHDTDNKEWDFSKTDITDINKYRKEEVYLNLLSNNEIQKEPSHYLYKMHHYGDNYNDSYLFQWIHQSISPENYLFDKDKDDNYIITQIPAIKASELSNLGELSLQAIKGPRFTGGNVILSSVSKIDNNDPLYGGTIKIPLLTAFNNTSKFKIRIYYAANHNYNHDYIGALLTINSQHVANFKFKQTFSGEDYSNLSYNNYQFDYLVQTVAFPQNTSDVTLNLQFFYDPKFLNDYKQIVIIDKIEFIPEN

SEQ ID NO: 49 - protein, 706 aa, Paenibacillus popilliae
MNNNFNGGNNTGNNFTGNTLSNGICTKKNMKGTLSRTAIFSDGISDDLICCLDPIYNNNDNNNDAICDELGLTPIDNNTICSTDFTPINVMRTDPFRKKSTQELTREWTEWKENSPSLFTPAIVGVVTSFLLQSLKKQATSFLLKTLTDLLFPNNSSLTMEEILRATEQYVQERLDTDTANRVSQELVGLKNNLTTFNDQVEDFLQNRVGISPLAIIDSINTMQQLFVNRLPQFQVSGYQVLLLPLFAQAATLHLTFLRDVIINADEWNIPTAQLNTYTRYFKEYIAEYSNYALSTYDDGFRTRFYPRNTLEDMLQFKTFMTLNALDLVSIWSLLKYVNLYVSTSANLYNIGDNKVNEGAYPISYGPFFNSYIQTKSNYVLSGVSGIGARFTYSTVLGRYLHDDLKNIITTYVGGTQGPNIGVQLSTTELDELKKQQQATRDSLVDFQFFTLNCMLPNPITAPYFATSLYESRYSSIGGYLRKDVFKSEDSTCGLGNPGAWTSYPDYYITNISATVQINGENTDTTPLYFKENRPITSTRGVNKVIAVYNRKANIAGTNQNGTMIHQAPPDGTGFTVSPLHPSANTITSYIKENYGNSGDSLHLKGQGYLHYMLSGNGQDRYRLVLRLSGAANQIKLQSPTTSIYAFDTSTNNEGITDNGSKFKDFAFSTPFVIPEQKEIVLYFEGVGSLDLMNLIFLPADDTPLY

SEQ ID NO: 50 - protein, 675 aa, Paenibacillus popilliae
MNNNGNALSRTALTPTNNKVISGDLVTNGLPPIDNNIICSNGFMPINVTRKNPFRKRTTQEFIREWTEWKENSPSLFTAPIVGVVTSTLLEALKKQVQSRLLLLMTNLLFPNNSTSTMEEILRATEQYVQEQLDTVTWNRVSQELEGLKNNLRTFNDQIDDFLQNRVEISPTAMIDSINTMQQVFVNRLPQFQLSDYQLLLLPLFAQGATLHLTFIRDIIINAGEWNIPEAQLNTCKRYLKQYVAQYSNYALSTYEGAFRARFYPRATLENMLQFKTFMTLNVLDLVSIWSLLKYMNLYISTSANLYNIGDNKVNEGEYSISYWPFFNSYIQTKSNYVLSGVSGYAIRWYYLNTFFGEYIQDNLYNIIASYVGGVNGPKIGVQLSTTELDKQIKQQARAGMPTGLDDLSFNCTLRNPTTVPYFACNFQELTSSGTAGTGGFIRSDVFRSEDNICGLGTGYASAWTSYPDYYITNISATVQVDGINIDITPLCFGEDRAITSTHGVNKVIAVYNRKANIAGTNQNGTMIHQAPNDGTGFTVSPLHLASFTHPSEAHIQENYGNSGDSLRLTGPTTAITYMLSGDGRTIYKLVLRVSGVITRITAKVRGNSIGYLEYINTVDNNQGITDNGSKFQDFEFRPTITIDAQTPIVLEFSATSNFDLMNLIFIPYYDTPIY

SEQ ID NO: 51 - protein, 695 aa, Paenibacillus popilliae
MNNYFIGKVLSGHHINNNGNGNTLSRTALTPTNNNVNRGDLVTNGLTPIDNNFIGSNGFIPRNVTRKDPFRKRTTQEFIREWTEWKEKSASLFTAPIVGVITSTLLEALKKLVAGRVLMSLTNLLFPNNSTSTMEEILRATEQYIQEQLDTVTWNRVSQELEGLKNDLRTFNDQIDDFLQNRVGISPLAIIDSINTMQQLFVNRLPQFQVSDDQVLLLPLFAQAVTLHLTFVRDIIINADEWNIPEAQLNTYKRYLKQYVAQYSNYALSTYEEAFRARFYPRNTVENMLEFKTFMTLNVLDLVSMWSLLKYVNLYVSTSANLYNIGDNKVNEGEYSISYWPFFNTYIQTKSNYVLSGVSGYAMRWSYTNPFFGEYIQDHLYNITASYIGGVNGPQIGQQLSTTELDQLVQQQARADIPVDFTQIPINCTLRNPLEVPYYATRFNELTSLGTAGVGGFVRSDVFISNDSVCGLGTNYSSGQTFYPDYYITNISATVQVNGTNTDISPLYFGENRAITSTNGVNKVIAIYNRKTNYDDFTNIRGTIVHEAPTDSTGFTISPLHLDTVNINSYLYIQENYGNNGDSLRVINRAIIKYRLSAARSVIYRLVLRVSGTASSIVAIYENYPVGSANQINTGTDNEGVIDNDSKFIDLIFNTPFSVSGTARELQLQVSGATTSSPLDIMNIILIPINDVPLY

SEQ ID NO: 52 - protein, 648 aa, Bacillus thuringiensis jegathesan 367
MHYYGNRNEYDILNASSNDSNMSNTYPRYPLANPQQDLMQNTNYKDWLNVCEGYHIENPREASVRAGLGKGLGIVSTIVGFFGGSIILDTIGLFYQISELLWPEDDTQQYTWQDIMNHVEDLIDKRITEVIRGNAIRTLADLQGKVDDYNNWLKKWKDDPKSTGNLSTLVTKFTALDSDFNGAIRTVNNQGSPGYELLLLPVYAQIANLHLLLLRDAQIYGDKWWSARANARDNYYQIQLEKTKEYTEYCINWYNKGLNDFRTAGQWVNFNRYRREMTLTVLDIISMFPIYDARLYPTEVKTELTREIYSDVINGEIYGLMTPYFSFEKAESLYTRAPHLFTWLKGFRFVTNSISYWTFLSGGQNKYSYTNNSSINEGSFRGQDTDYGGTSSTINIPSNSYVYNLWTENYEYIYPWGDPVNITKMNFSVTDNNSSKELIYGAHRTNKPVVRTDFDFLTNKEGTELAKYNDYNHILSYMLINGETFGQKRHGYSFAFTHSSVDPNNTIAANKITQIPVVKASSINGSISIEKGPGFTGGDLVKMRADSGLTMRFKAELLDKKYRVRIRYKCNYSSKLILRKWKGEGYIQQQIHNISPTYGAFSYLESFTITTTENIFDLTMEVTYPYGRQFVEDIPSLILDKIEFLPTN

SEQ ID NO: 53 - protein, 682 aa, Bacillus thuringiensis higo
MNSYQNKNEYEILDAKRNTCHMSNCYPKYPLANDPQMYLRNTHYKDWINMCEEASYASSGPSQLFKVGGSIVAKILGMIPEVGPLLSWMVSLFWPTIEEKNTVWEDMIKYVANLLKQELTNDTLNRATSNLSGLNESLNIYNRALAAWKQNKNNFASGELIRSYINDLHILFTRDIQSDFSLGGYETVLLPSYASAANLHLLLLRDVAIYGKELGYPSTDVEFYYNEQKYYTEKYSNYCVNTYKSGLESKKQIGWSDFNRYRREMTLSVLDIVALFPLYDTGLYPSKDGKIHVKAELTREIYSDVINDHVYGLMVPYISFEHAESLYTRRPHAFTWLKGFRFVTNSINSWTFLSGGENRYFLTHGEGTIYNGPFLGQDTEYGGTSSYIDISNNSSIYNLWTKNYEWIYPWTDPVNITKINFSITDNSNSSESIYGAERMNKPTVRTDFNFLLNRAGNGPTTYNDYNHILSYMLINGETFGQKRHGYSFAFTHSSVDRYNTIVPDKIVQIPAVKTNLVGANIIKGPGHTGGDLLKLEYERFLSLRIKLIASMTFRIRIRYASNISGQMMINIGYQNPTYFNIIPTTSRDYTELKFEDFQLVDTSYIYSGGPSISSNTLWLDNFSNGPVIIDKIEFIPLGITLNQAQGYDTYDQNANGMYHQNYSNSGYNYNQEYNTYYQSYNN

SEQ ID NO: 54 - protein, 1176 aa, Bacillus thuringiensis kurstaki HD1
MDNNPNINECIPYNCLSNPEVEVLGGERIETGYTPIDISLSLTQFLLSEFVPGAGFVLGLVDIIWGIFGPSQWDAFPVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFSNYDSRRYPIRTVSQLTREIYTNPVLENFDGSFRGMAQRIEQNIRQPHLMDILNSITIYTDVHRGFNYWSGHQITASPVGFSGPEFAFPLFGNAGNAAPPVLVSLTGLGIFRTLSSPLYRRIILGSGPNNQELFVLDGTEFSFASLTTNLPSTIYRQRGTVDSLDVIPPQDNSVPPRAGFSHRLSHVTMLSQAAGAVYTLRAPTFSWQHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKQELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVLPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 55 - protein, 1176 aa, Bacillus thuringiensis kurstaki HD-1-02
MDNNPNINECIPYNCLSNPEVEVLGGGRIETGYTPIDISLSLTQFLLSEFVPGAGFVLGLVDIIWGIFGPSQWDTFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFSNYDSRRYPIRTVSQLTREIYTNPVLENFDGSFRGMAQRIEQNIRQPHLMDILNSITIYTDVHRGFNYWSGHQITASPVGFSGPEFAFPLFGNAGNAAPPVLVSLTGLGIFRTLSSPLYRRIILGSGPNNQELFVLDGTEFSFASLTTNLPSTIYRQRGTVDSLDVIPPQDNSVPPRAGFSHRLGHVTMLSQAAGAVYTLRAPTFSWQHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKQELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKIAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYSNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 56 - protein, 1176 aa, Bacillus thuringiensis kurstaki
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFSNYDSRRYPIRTVSQLTREIYTNPVLENFDGSFRGMAQRIEQNIRQPHLMDILNSITIYTDVHRGFNYWSGHQITASPVGFSGPEFAFPLFGNAGNAAPPVLVSLTGLGIFRTLSSPLYRRIILGSGPNNQELFVLDGTEFSFASLTTNLPSTIYRQRGTVDSLDVIPPQDNSVPPRAGFSHRLSHVTMLSQAAGAVYTLRAPTFSWQHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKQELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 57 - protein, 1176 aa, Bacillus thuringiensis Ly30
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFSNYDSRRYPIRTVSQLTREIYTNPVLENFDGSFRGMAQRIEQNIRQPHLMDILNSITIYTDVHRGFNYWSGHQITASPVGFSGPEFAFPLFGNAGNAAPPVLVSLTGLGIFRTLSSPLYRRIILGSGPNNQELFVLDGTEFSFASLTTNLPSTIYRQRGTVDSLDVIPPQDNSVPPRAGFSHRLSHVTMLSQAAGAVYTLRAPTFSWQHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKQELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 58 - protein, 1180 aa, Bacillus thuringiensis sotto
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFSNYDSRRYPIRTVSQLTREIYTNPVLENFDGSFRGMAQRIEQNIRQPHLMDILNRITIYTDVHRGFNYWSGHQITASPVGFSGPEFAFPLFGNAGNAAPPVLVSLTGLGIFRTLSSPLYRRIILGSGPNNQELFVLDGTEFSFASLTTNLPSTIYRQRGTVDSLDVIPPQDNSVPPRAGFSHRLSHVTMLSQAAGAVYTLRAPTFSWQHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKQELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 59 - protein, 1183 aa, Bacillus thuringiensis
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFSNYDSRRYPIRTVSQLTREIYTNPVLENFDGSFRGMAQRIEQNIRQPHLMDILNSITIYTDVHRGFNYWSGHQITASPVGFSGPEFAFPLFGNAGNAAPPVLVSLTGLGIFRTLSSPLYRRIILGSGPNNQELFVLDGTEFSFASLTTNLPSTIYRQRGTVDSLDVIPPQDNSVPPRAGFSHRLSHVTMLSQAAGAVYTLRAPTFSWQHRSAEFNNIIPSSQVTQIPLTKSTNLGSGTSVVKGPGFTGGDILRRTSPGQISTLRVNITAPLSQRYRVRIRYASTTNLQFHTSIDGRPINQGNFSATMCSGSNLQSGSFRTVGFTTPFNFPNGSSVFTLSAHVFNSGNEVYIDRIEFVPAEVTFEAEYDLERAQKAVNELFTSSNQIGLKTDVTDYHIDQVSNLVECLSDEFCLDEKQELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAQSPIGKCGEPNRCAPHLEWNPDLDCSCRDEGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEEVDA

SEQ ID NO: 60 - protein, 1163 aa, Bacillus thuringiensis INTA Mol-12
NECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFSNYDSRRYPIRTVSQLTREIYTNPVLENFDGSFRGMAQRIGQNIRQPHLMDILNSITIYTDVHRGFNYWSGHQITASPVGFSGPEFAFPLFGNAGNAAPPVLVSLTGLGIFRTLSSPLYRRIILGSGPNNQELFVLDGTEFSFASLTTNLPSTIYRQRGTVDSLDVIPPQDNSVPPRAGFSHRLSHVTMLSQAAGAVYTLRAPTFSWQHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKQELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVE

SEQ ID NO: 61 - protein, 1175 aa, Bacillus thuringiensis LS-R-21
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFSNYDSRRYPIRTVSQLTREIYTNPVLENFDGSFRGMAQRIEQNIRQPHLMDILNSITIYTDVHRGFNYWSGHQITASPVGFSGPEFAFPLFGNAGNAAPPVLVSLTGLGIFRTLSSPLYRRIILGSGPNNQELFVLDGTEFSFASLTTNLPSTIYRQRGTVDSLDVIPPQDNSVPPRAGFSHRLSHVTMLSQAAGAVYTLRAPTFSWQHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKQELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLME

SEQ ID NO: 62 - protein, 934 aa, Bacillus thuringiensis sotto
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFSNYDSRRYPIRTVSQLTREIYTNPVLENFDGSFRGMAQRIEQNIRQPHLMDILNRITIYTDVHRGFNYWSGHQITASPVGFSGPEFAFPLFGNAGNAAPPVLVSLTGLGIFRTLSSPLYRRIILGSGPNNQELFVLDGTEFSFASLTTNLPSTIYRQRGTVDSLDVIPPQDNSVPPRAGFSHRLSHVTMLSQAAGAVYTLRAPTFSWQHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKQELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKR

SEQ ID NO: 63 - protein, 1176 aa, Bacillus thuringiensis aizawai IPL7; identical to SEQ ID NO: 57

SEQ ID NO: 64 - protein, 1176 aa, Bacillus thuringiensis entomocidus
MDNNPNINECIPYNCLSNPEVEVLGGERIETGYTPIDISLSLTQFLLSEFVPGAGFVLGLVDIIWGIFGPSQWDAFPVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFSNYDSRRYPIRTVSQLTREIYTNPVLENFDGSFRGMAQRIEQNIRQPHLMDILNSITIYTDVHRGFNYWSGHQITASPVGFSGPEFAFPLFGNAGNAAPPVLVSLTGLGIFRTLSSPLYRRIILGSGPNNQELFVLDGTEFSFASLTTNLPSTIYRQRGTVDSLDVIPPQDNSVPPRAGFSHRLSHVTMLSQAAGAVYTLRAPTFSWQHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKQELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 65 - protein, 1176 aa, Bacillus thuringiensis Fu-2-7
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFSNYDSRRYPIRTVSQLTREIYTNPVLENFDGSFRGMAQRIEQNIRQPHLMDILNSITIYTDVHRGFNYWSGHQITASPVGFSGPEFAFPLFGNAGNAAPPVLVSLTGLGIFRTLSSPLYRRIILGSGPNNQELFVLDGTEFSFASLTTNLPSTIYRQRGTVDSLDVIPPQDNSVPPRAGFSHRLSHVTMLSQAAGAVYTLRAPTFSWQHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKQELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRISTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 66 - protein, 620 aa, Bacillus thuringiensis kurstaki NRD-12
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFSNYDSRRYPIRTVSQLTREIYTNPVLENFDGSFRGMAQRIEQNIRQPHLMDILNSITIYTDVHRGFNYWSGHQITASPVGFSGPEFAFPLFGNAGNAAPPVLVSLTGLGIFRTLSSPLYRRIILGSGPNNQELFVLDGTEFSFASLTTNLPSTIYRQRGTVDSLDVIPPQDNSVPPRAGFSHRLSHVTMLSQAAGAVYTLRAPTFSWQHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQ

SEQ ID NO: 67 - protein, 1176 aa, Bacillus thuringiensis C12
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFSNYDSRRYPIRTVSQLTREIYTNPVLENFDGSFRGMAQRIEPEYRQPHLMDILNSITIYTDVHRGFNYWSGHQITTSPVGFSGPEFAFPLFGNAGNAAPPVLVSLTGLGIFRTLSSPLYRRIILGSGPNNQELFVLDGTEFSFASLTTNLPSTIYRQRGTVDSLDVIPPQDNSVPPRAGFSHRLSHVPMLSQAAGAVYTLRASLFLRLDPSAEFNNIIPSFTNYQIPLTKSTNLGSGTSVVKGPGFTGGDILRRTSPGLISTLRVNITAPLSQRYRVRIRYASTTNLQFHTSIDGRPINQGNFYATMSSGSNLQSGSFRTVGFTTPFNFSNGSSVFTLSAHVFNSGNEVYIDRIEFVPAEVTFEAEYDLERAQNGVNQLFTSSNQIGLKTDGTDYHIDQVSNLVECLSDEFCLDEKQELSEKVKHAKRLSDERNLLQDPNFRGINRQLDRGWRGSHDITIQGGDDVFKENYVTLLGTFDECYPTYLYQKIDQSKLKAYTSYQLRGYIEDSQDLEIYLIRYNAKQQTVNVPGTGSLWPVSAPKPIGKCGEPNRCAPHLEWNPDLDCSCRDGEKCAHHSHHFSLDIDVGCTDLNEDLGVWVIFKIKTEDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTGLPVGYVTKALEYFPETDKVWIEIGETEGTFIVDSVELLLMEE

SEQ ID NO: 68 - protein, 1180 aa, Bacillus thuringiensis dendrolimus T84A1; identical to SEQ ID NO: 58

SEQ ID NO: 69 - protein, 1155 aa, Bacillus thuringiensis berliner 1715
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDHAVRWYNTGLERVWGPDSRDWIRYNQFRRELTLTVLDIVSLFPNYDSRTYPIRTVSQLTREIYTNPVLENFDGSFRGSAQGIEGSIRSPHLMDILNSITIYTDAHRGEYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 70 - protein, 1155 aa, Bacillus thuringiensis kurstaki S93; identical to SEQ ID NO: 69

SEQ ID NO: 71 - protein, 1155 aa, Bacillus thuringiensis c005; identical to SEQ ID NO: 69

SEQ ID NO: 72 - protein, 1155 aa, Bacillus thuringiensis
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDHAVRWYNTGLERVWGPDSRDWIRYNQFRRELTLTVLDIVSLFPNYDSRTYPIRTVSQLTREIYTNPVLENFDGSFRGSAQGIEGSIRSPHLMDILNSITIYTDAHRGEYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKKELSEKVKHAKRLSDERNLLQDPNLRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEELGVWVIFKIKTQDGHARLGNLEFLEEKPLVGEALARVKRAEKKWRDKREKLEWETNIVYKEAKESVDALFINSQYDRLQADTNIAMIHAADKRVHSIREAYLPELSVIPGVNAAIFEELEGRISTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 73 - protein, 1155 aa, Bacillus thuringiensis B-Hm-16; identical to SEQ ID NO: 69

SEQ ID NO: 74 - protein, 1155 aa, Bacillus thuringiensis AC-11
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYRVPLLSVYVQAVNLHLSVLRDVLVFGQRWGFDAATINSRYNDLTRLIGNYTDHAVRWYNTGLERVWGPDSRDWIRYNQFRRELTLTVLDIVSLFPNYDSRTYPIRTVSQLTREIYTNPVLENFDGSFRGSAQGIEGSIRSPHLMDILNSITIYTDAHRGEYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDAVFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEEYGEGCVTIHEIENNTAELKFSNCVEEEVYPNNTVTCNDYTATQEEYEGTYTSRNRGYDGAYESNSSVPADYASAYEEKAYTDGRRDNPCESNRGYGDYTPLPAGYVTRELEYFPETDKVWIEIGETEGTFIVDSVELLLMEE

SEQ ID NO: 75 - protein, 1156 aa, Bacillus thuringiensis WB9
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLPVLRDVSVFGQRWGFDAATINSRYNDLTRLIGNYTDHAVRWYNTGLERVWGPDSRDWIRYNQFRRELTLTVLDIVSLFPNYDSRTYPIRTVSQLTREIYTNPVLENFDGSFRGSAQGIEGSIRSPHLMDILNSITIYTDAHRGEYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIGAPMFSWIHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCGAHHSHHFSLDIDVGCTDLNEDLGVWVIFKIKTQDGHARLGNLEFLEEKPLVGEALARVKRAEKKWRGKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 76 - protein, 1177 aa, Bacillus thuringiensis
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDYAVRWYNTGLERVWGPDSRDWIRYNQFRRELTLTVLDIVSLFPNYDSRTYPIRTVSQLTREIYTNPVLENFDGSFRGSAQGIEGSIRSPHLMDILSSITIYTDAHRGEYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKQEVSEKVKHAKRLSDERNLLQDPNFRGINRQLDRGWRGSTDITIQGGDDVFKENYVTLPGTFDECYPTYLYQKIDESKLKAYTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGCIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEIYPNNTVTCNDYTVNQEEYEGAYTSRNRGYNEAPSVPADYASVYEEKSYTDGRRENPCEFNRGYRDYTLLPVGYVTKELEYFPETDKVWIEIGETEGTFIVDSVELLLMEE

SEQ ID NO: 77 - protein, 1155 aa, Bacillus thuringiensis X-2
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDHAVRWYNTGLERVWGPDSRDWIRYNQFRRELTLTVLDIVSLFPNYDSRTYPIRTVSQLTREIYTNPVLENFDGSFRGSAQGIEGSIRSPHLMDILNSITIYTDAHRGEYYWSGHQIMASPVGFSGPEFTFPLYGTMGNAAPQQRIVAQLGQGVYRTLSSTLYRRPFNIGINNQQLSVLDETEFAYGTSSNLPSAVYRKSGTVDSLDEIPPQNNNVPPRQGFSHRLSHVSMFRSGFSNSSVSIIRAPMFSWIHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSFNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHPADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMKE

SEQ ID NO: 78 - protein, 1156 aa, Bacillus thuringiensis kurstaki
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDHRVRWYNTGLERVWGPDSRDWIRYNQFRRELTLTVLDIVSLFPNYDSRTYPIRTVSQLTREIYTNPVLENFDGSFRGSAQGIEGSIRSPHLMDILNSITIYTDAHRGEYYWSGHQIMASPVGFSGPEFTFPLYGTMGNAAPQQRIVAQLGQGVYRTLSSTLYRRPFNIGINNQQLSGPDGGRICLWNLLKFGQPPYTEKAEPVDSPDEIPPQNNNVPPRQGFSHRCLAYVSMFYSGFSNSSVSVIRAPNDSSWTYCSAEFGDVIPSSQITQIPLTKLQSWLWNSVVKGLGFTGGDILEELTGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKKELSEKVKHAKRLSDERNLLQDPNFRGINRQLDRGWRGNTDITIQGGHDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 79 - protein, 1155 aa, Bacillus thuringiensis C008
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDHAVRWYNTGLERVWGPDSRDWIRYNQFRRELTLTVLDIVSLFPNYDSRTYPIRTVSQLTREIYTNPVLENFDGSFRGSAQGIEGSIRSPHLMDILNSITIYTDAHRGEYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNPGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 80 - protein, 1155 aa, Bacillus thuringiensis IS5056
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDHAVRWYNTGLERVWGPDSRDWIRYNQFRRELTLTVLDIVSLFPNYDSRTYPIRTVSPLTREIYTNPVLENFDGSFRGSAQGIEGSIRSPHLMDILNSITIYTDAHRGEYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 81 - protein, 1155 aa, Bacillus thuringiensis S2491Ab
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVLVFGQRWGFDAATINSRYNDLTRLIGNYTDHAVRWYNTGLERVWGPDSRDWIRYNQFRRELTLTVLDIVSLFPNYDSRTYPIRTVSQLTREIYTNPVLENFDGSFRGSAQGIEGSIRSPHLMDILNSITIYTDAHRGEYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKKELSEKVKHAKRLSDERSLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWEIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRRYDGAYESNFSVPADYASAYEEKAYTDGRRDNPCESNRGYGDYTPLPAGYVTKELECFPETDKVWIEIGETEGTFIVDSVELLLMEE

SEQ ID NO: 82 - protein, 1154 aa, Bacillus thuringiensis LS-R-30
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDHAVRWYNTGLERVWGPDSRDWIRYNQFRRELTLTVLDIVSLFPNYDSRTYPIRTVSQLTREIYTNPVLENFDGSFRGSAQGIEGSIRSPHLMDILNSITIYTDAHRGEYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLME

SEQ ID NO: 83 - protein, 1155 aa, Bacillus thuringiensis serovar kurstaki
  REGION 1..1155: note = misc_feature - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGHRWGFDAATINSRYNDLTRLIGNYTDHAVRWYNTGLERVWGPDSRDWIRYNQFRRELTLTVLDIVSLFPNYDSRTYPIRTVSQLTREIYTNPVLENFDGSFRGSAQGIEGSIRSPHLMDILNSITIYTDAHRGEYYWSGHQIMASPVGFSGPESTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIPSSQITQIPLTKSTNLGSGTSVVKAPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLDIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADERVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDEPKFSYCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 84 - protein, 1155 aa, Bacillus thuringiensis kurstaki HD1; identical to SEQ ID NO: 69

SEQ ID NO: 85 - protein, 1155 aa, Bacillus thuringiensis kurstaki HD1; identical to SEQ ID NO: 69

SEQ ID NO: 86 - protein, 1155 aa, Bacillus thuringiensis berliner 1715
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDHAVRWYNTGLERVWGPDSRDWIRYNQFRRELTLTVLDIVSLFPNYDSRTYPIRTVSQLTREIYTNPVLENFDGSFRGSAQGIEGSIRSPHLMDILNSITIYTDAHRGEYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYLTYLYQKIDESKLKAYTRYQLRGYIEDSQDLEIYLIRYNAKHETVNVPGTGSLWRLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 87 - protein, 1155 aa, Bacillus thuringiensis kurstaki NRD-12
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDHAVRWYNTGLERVWGPDSRDWIRYNQFRRELTLTVLDIVSLFPNYDSRTYPIRTVSQLTREIYTNPVLENFDGSFRGSAQGIEGSIRSPHLMDILNSITIYTDAHRGEYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSANFNNIIPSSQITQIPLTKSTNLGSGTSVVKGPGFTGGDILRRTSPGQISTLRVNITAPLSQRYRVRIRYASTTNLQFHTSIHGRPINQGNFSATMSSGSNLQSGSFRHLGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKEELSEKVKHANGLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWVIFKIKTQDGHARLGILEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGTGCVTIHEIENNTDELKFSNCVEEEVYPNNTVTCNDYTATQEEYGGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 88 - protein, 1155 aa, Bacillus thuringiensis aizawai IC1
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDHAVRWYNTGLERVWGPDSRDWIRYNQFRRELTLTVLDIVSLFPNYDSRTYPIRTVSQLTREIYTNPVLENFDGSFRGSAQGIEGSIRSPHLMDILNSITIYTDAHRGEYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRPPMFSWIHRSAEFNNIIPSSQITQIPLTKSTNLGSGTSVVKGPGFTGGDILRRTSPGQISTLRVNITAPLSQRYRVRIRYASTTNLQLHTSIDGRIINQGNFSATMSSGSNLQSGSFRIVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYLTYLYQKIDESKLKAYTRYQLRGYIEDSQDLEIYLIRYNAKHETVNVPGTGSLWRLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 89 - protein, 1155 aa, Bacillus thuringiensis aizawai IPL7
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDHAVRWYNTGLERVWGPDSRDWIRYNQFRRELTLTVLDIVSLFPNYDSRTYPIRTVSQLTREIYTNPVLENFDGSFRALAQGIEGSIRSPHLMDILNSITIYTDAHRGEYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNFVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 90 - protein, 1155 aa, Bacillus thuringiensis aizawai HD133; identical to SEQ ID NO: 69

SEQ ID NO: 91 - protein, 1118 aa, Bacillus thuringiensis kunthala RX24
MDNNLNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDHAVRWYNTGLERVWGPDSRDWIRYNQFRRELTLTVLDIVSLFPNYDSRTYPIRTVSQLTREIYTNPVLENFDGSFRGSAQGIEGSIRSPHLMDILNSITIYTDAHRGEYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGAFMTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYLTLLGTFDECFQRIYIKKVDESKFKAYTRDQLRGYIEDSQDLEIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCKIILRLKKNMRVRTLLVIEDMTEPMKAILLYQLIMHQPMKKKHIQMDEETILVNLTEDMGITHHYQLAM

SEQ ID NO: 92 - protein, 1118 aa, Bacillus thuringiensis kunthala RX28
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRREITLTVLDIVALFPNYDSRTYPIRTVSQLTREIYTNPVLENFDGSFRGSAQGTERSIRSPHLMDILNSITIYRMHIEDIIIGQGIKKRLLLEGFQGQNSLFLYLGRGEMQLHPNRLLLNKVRACIEHYRPLYIEDLFKEGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKQELSEKVKHAKRLSDERNLLQDPNFRGINRQLDRGWRGSTDITIQGGDDVFKENYVTLLGTFDECFQRIYIKKVDESKFKAYTRDQLRGYIEDSQDLEIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCKIILRLKKNMRVRTLLVIEDMTEPMKAILLYQLIMHQPMKKKHIQMDEETILVNLTEDMGITHHYQLAM

SEQ ID NO: 93 - protein, 373 aa, Bacillus thuringiensis ly4a3
RDMTVIVLDIVSLFPNYDSRTYPIRTVSQLTREIYTNPVLENFDGSFRGSAQGIEGSIRSPHLMDILNSITIYTDAHRGEYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDKIEFIP

SEQ ID NO: 94 - protein, 1178 aa, Bacillus thuringiensis kurstaki HD73
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 95 - protein, 1178 aa, Bacillus thuringiensis kurstaki YBT-1520; identical to SEQ ID NO: 94

SEQ ID NO: 96 - protein, 1178 aa, Bacillus thuringiensis
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTFYRRPFNIGINNQQLSVLDGTEFAYGTSSNLPSAVYRKSGTVDSLDEIPPQNNNVPPRQGFSHRLSHVSMFRSGSSNSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 97 - protein, 723 aa, Bacillus thuringiensis kurstaki HD1
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTFYRRPFNIGINNQQLSVLDGTEFAYGTSSNLPSAVYRKSGTVDSLDEIPPQNNNVPPRQGFSHRLSHVSMFRSGSSSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLS

SEQ ID NO: 98 - protein, 1177 aa, Bacillus thuringiensis Ly30
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTFYRRPFNIGINNQQLSVLDGTEFAYGTSSNLPSAVYRKSGTVDSLDEIPPQNNNVPPRQGFSHRLSHVSMFRSGSSSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLGEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGYVTIHEIENNTDELKFSNCVEEEIYPNNTVTCNDYTVNQEEYGGAYTSRSRGYNEAPSVPADYASVYEEKSYTDGRRENPCEFNRGYRDHTPLPVGYVTKELEYFPETDKVWIEIGETEGTFIVDSVELLLMEE

SEQ ID NO: 99 - protein, 1177 aa, Bacillus thuringiensis from Taiwan
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTFYRRPFNIGINNQQLSVLDGTEFAYGTSSNLPSAVYRKSGTVDSLDEIPPQNNNVPPRQGFSHRLSHVSMFRSGSSSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 100 - protein, 1178 aa, Bacillus thuringiensis H3
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSTQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 101 - protein, 1177 aa, Bacillus thuringiensis kenyae HD549
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTFYRRPFNIGINNQQLSVLDGTEFAYGTSSNLPSAVYRKSGTVDSLDEIPPQNNNVPPRQGFSHRLSHVSMFRSGSSSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 102 - protein, 1177 aa, Bacillus thuringiensis SK-729
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDHAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTFYRRPFNIGINNQQLSVLDGTEFAYGTSSNLPSAVYRKSGTVDSLDEIPPQNNNVPPRQGFSHRLSHVSMFRSGSSSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLYVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTCLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRFAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVESLLMEE

SEQ ID NO: 103 - protein, 1178 aa, Bacillus thuringiensis C-33
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVLLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPVDYASVYEEKSYTDGRRENPCEFNRGYRDYTPLPVGYVTKELEYFPETDKVWIEIGETEGTFIVDSVELLLMEE

SEQ ID NO: 104 - protein, 1177 aa, Bacillus thuringiensis kenyae
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDHAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTFYRRPFNIGINNQQLSVLDGTEFAYGTSSNLPSAVYRKSGTVDSLDEIPPQNNNVPPRQGFSHRLSHVSMFRSGSSSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTCLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRFAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 105 - protein, 1177 aa, Bacillus thuringiensis
MDNNPNTNECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTFYRRPFNIGINNQQLSVLDGTEFAYGTSSNLPSAVYRKSGTVDSLDEIPPQNNNVPPRQGFSHRLSHVSMFRSGSSSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 106 - protein, 1164 aa, Bacillus thuringiensis INTA Mol-12
NECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTFYRRPFNIGINNQQLSVLDGTEFAYGTSSNLPSAVYRKSGTVDSLDEIPPQNNNVPPRQGFSHRLSHVSMFRSGSSSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVE

SEQ ID NO: 107 - protein, 1178 aa, Bacillus thuringiensis W015-1
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDYAVRWYNTGLERVWGPDSRDWVRYNQFTRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIMRAPMFSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIKIGETEGTFIVDSVELLLMEE

SEQ ID NO: 108 - protein, 960 aa, Bacillus thuringiensis serovar kurstaki
  SITE 560: note = misc_feature - Xaa can be any naturally occurring amino acid
MDNNPNTNECIPYNCLSNPEVEVLGGERIETGYTPIDISLSLTQFLLSEFVPGAGFVLGLVDIIWGIFGPSQWDDAFLVQIEQLINQRIEEFARNPAISRLEGGLSNLYQIYAESFREWEADPTNPALREEMRIQFNDMNSALTTAIPLLAVQNYQVPLLSVYVQAANLHYSVLRDVSVFGQRWGFDAAATINSRYNDLTSPIGNYTDYAVRWYNTGLERVWGPDSRDWVRYNQFRRELTLTVLDIVALLFPNYDSRRRRYPIRTVSQLTREIYTNPVLENFDGSSFRGSAQGIERSSIRSPHLMDILNSITIYTDAHRGYYYCSGHQIMASPVGFSGPEFTFPLYGTMGNAAPQQRMVAQLGQGVYRTLSSSTYYRRPFNIGINNQQLSVLDGTEFAYGTSSNLPSAVYRKSGTVDSLDEIPPQNNNVPPRQGFSHRLSHVSMFRSGFSNSSVSIISAPMFSWIHRSAEFNNTIASDSITQIPAAVKGNFLFNGSVISGPGFTGGDLVRLNSSGNNIQNRGYIEVPIHFPSTSTRYRVRVRYASVTPIHLNVNWGNSSXSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTYLSDEFCLDEKRELSEKVKHAKRLSDERNLLQDSNFKDINRQPERGWGGSTGITIIQGGDDVFKENYVTLSGTFDECYPTYLYQKIDESKLKAFTRYQLRGYIEDSQDLEIYLIRYNAKHETVNRYGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAAADDNRVHSIREAYL

SEQ ID NO: 109 - protein, 1177 aa, Bacillus thuringiensis 146-158-01
MDNNPNINECNPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFSNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTFYRRPFNIGINNQQLSVLDGTEFAYGTSSNLPSAVYRKSGTVDSLDEIPPQNNNVPPRQGFSHRLSHVSMFRSGSSSSVSIIRAPMFSWIHRSAEFNNIIASDSITQIPAVKGNFLFNGSVISGPGFTGGDLVRLNSSGNNFQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 110 - protein, 1177 aa, Bacillus thuringiensis Tm37-6
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYSQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTFYRRPFNIGINNQQLSVLDGTEFAYGTSSNLPSAVYRKSGTVDSLDEIPPQNNNVPPRQGFSHRLSHVSMFRSGSSSSVSIIRAPTFSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLHQKIDESKLKAFTRHQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 111 - protein, 1177 aa, Bacillus thuringiensis Tm41-4
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTFYRRPFNIGINNQQLSVLDGTEFAYGTSSNLPSAVYRKSGTVDSLDEIPPQNNNVPPRQGFSHRLSHVSMFRSGSSSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSYSVPLGGG

SEQ ID NO: 112 - protein, 1177 aa, Bacillus thuringiensis Tm44-1B
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAASQQRIVAQLGQGVYRTLSSTFYRRPFNIGINNQQLSVLDGTEFAYGTSSNLPSAVYRKSGTVDSLDEIPPQNNNVPPRQGFSHRLSHVSMFRSGSSSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVQYPVTEE

SEQ ID NO: 113 - protein, 1178 aa, Bacillus thuringiensis Q-12
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQVMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMLSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSSTFDECYPTYLYQKIDESKLKAFTRYRLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 114 - protein, 1164 aa, Bacillus thuringiensis INTA TA24-6; identical to SEQ ID NO: 106

SEQ ID NO: 115 - protein, 618 aa, Bacillus thuringiensis BTS89A
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTFYRRPFNIGINNQQLSVLDGTEFAYGTSSNLPSAVYRKSGTVDSLDEIPPQNNNVPPRQGFSHRLSHVSMFRSGSSSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLE

SEQ ID NO: 116 - protein, 1178 aa, Bacillus thuringiensis S1478-1
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIRVTATLEAEYNLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 117 - protein, 1178 aa, Bacillus thuringiensis S3299-1
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEMCAHHSHHFSLDIDVGCTDLNEDLGVWVIFKIKTQDGHARLGNLEFLEEKPLVGEALARVKRAEKKWRDKRGKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETGGTFIVDSVELLLMEE

SEQ ID NO: 118 - protein, 1177 aa, Bacillus thuringiensis ZQ-89
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTFYRRPFNIGINNQQLSVLDGTEFAYGTSSNLPSAVYRKSGTVDSLDEIPPQNNNVPPRQGFSHRLSHVSMFRSGSSSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAKIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 119 - protein, 1172 aa, Bacillus thuringiensis SK-711
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDHAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTFYRRPFNIGINNQQLSVLDGTEFAYGTSSNLPSAVYRKSGTVDSLDEIPPQNNNVPPRQGFSHRLSHVSMFRSGSSSSVSIIRAPMFSWIHRSAEFNNIIAPDSITQIPAVKGNFLFNGSVISGPGFTGGDLVRLNSSGNNIQNRGYIEVPIHFPSTSTRYRVRVRYASVTPIHLYVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTCLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRFAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVEL

SEQ ID NO: 120 - protein, 608 aa, Bacillus thuringiensis SK-783
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDHAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTFYRRPFNIGINNQQLSVLDGTEFAYGTSSNLPSAVYRKSGTVDSLDEIPPQNNNVPPRQGFSHRLSHVSMFRSGSSSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLYVNWGNSSIFSNTVPATATSLDNLQSSDFGYFESANAFTSSLGNIVGVRNFSGTAGVIIDRFEFIPVT

SEQ ID NO: 121 - protein, 1178 aa, Bacillus thuringiensis kurstaki PS85A1
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 122 - protein, 1177 aa, Bacillus thuringiensis kurstaki PS81GG; identical to SEQ ID NO: 101

SEQ ID NO: 123 - protein, 607 aa, Bacillus thuringiensis kurstaki NRD-12
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTFYRRPFNIGINNQQLSVLDGTEFAYGTSSNLPSAVYRKSGTVDSLDEIPPQNNNVPPRQGFSHRLSHVSMFRSGSSSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPV

SEQ ID NO: 124 - protein, 1178 aa, Bacillus thuringiensis kurstaki HD73; identical to SEQ ID NO: 94

SEQ ID NO: 125 - protein, 1178 aa, Bacillus thuringiensis kurstaki HD73; identical to SEQ ID NO: 94

SEQ ID NO: 126 - protein, 1178 aa, Bacillus thuringiensis DSIR732; identical to SEQ ID NO: 94

SEQ ID NO: 127 - protein, 1179 aa, Bacillus thuringiensis aizawai PS81I
MEIMNNQNQCVPYNCLNDPTIEILEGERIETGYTPIDISLSLTQFLLSEFVPGAGFVLGLIDLIWGFVGPSQWDAFLVQIEQLINQRIEEFARNQAISRLEGLSNLYQIYAEAFREWEADPTNPALTEEMRIQFNDMNSALTTAIPLFTVQNYQVPLLSVYVQAANLHLSVLRDVSVFGQRWGFDVATINSRYNDLTRLIGTYTDYAVRWYNTGLERVWGPDSRDWVRYNQFRRELTLTVLDIVSLFPNYDSRTYPIRTVSQLTREIYTNPVLENFDGSFRGMAQRIEQNIRQPHLMDLLNSITIYTDVHRGFNYWSGHQITASPVGFAGPEFTFPRYGTMGNAAPPVLISTTGLGIFRTLSSPLYRRIILGSGPNNQNLFVLDGTEFSFASLTADLPSTIYRQRGTVDSLDVIPPQDNSVPARAGFSHRLSHVTMLSQAAGAVYTLRAPTFSWRHRSAEFSNLIPSSQITQIPLTKSINLGSGTSVVKGPGFTGGDILRITSPGQISTLRVTITAPLSQRYRVRIRYASTTNLQFHTSIDGRPINQGNFSATMSSGGNLQSGSFRTAGFTTPFNFSNGSSIFTLSAHVFNSGNEVYIERIEFVPAEVTFEAEYDLERAQEAVNALFTSSNQLGLKTNVTDYHIDQVSNLVECLSGEFCLDEKRELSEKVKHANRLSDERNLLQDPNFRGINRQPDRGWRGSTDITIQGGDDVFKENYVTLPGTFNECYPTYLYQKIDESKLKAYTRYQLRGYIEDSQHLEIYLIRYNTKHETVNVPGTGSLWPLSVENPIGKCGEPNRCAPQLEWNPDLDCSCRDGEKCAHHSHHFSLDIDIGCTDLNENLGVWVIFKIKMQDGHARLGNLEFLEEKPLVGESLARVKRAEKKWRDKREKLQVETNIVYKEAKESVDALFVNSQYDRLQADTDIAMIHAADKRVHRIREAYLPELSVIPGVNAGIFEELEGRIFTAYSLYDARNVIKNGDFNNGLSCWNVKGHVDVEEQNNHRSVLVVPEWEAEVSQEVRVCPGRGYILRVTAYKEGYGEGCVTIHEIEDNTDELKFSNCVEEEVYPNNTVTCNDYTANQEEYGGAYTSRNRGYGESYESNSSIPAEYAPVYEEAYIDGRKENPCESNRGYGDYTPLPAGYVTKELEYFPETDKVWIEIGETEGTFIVDSVELLLMEE

SEQ ID NO: 128 - protein, 1179 aa, Bacillus thuringiensis PS81RR1
MEIMNNQNQCVPYNCLNDPTIEILEGERIETGYTPIDISLSLTQFLLSEFVPGAGFVLGLIDLIWGFVGPSQWDAFLVQIEQLINQRIEEFARNQAISRLEGLSNLYQIYAEAFREWEADPTNPALTEEMRIQFNDMNSALTTAIPLFTVQNYQVPLLSVYVQAANLHLSVLRDVSVFGQRWGFDVATINSRYNDLTRLIGTYTDYAVRWYNTGLERVWGPDSRDWVRYNQFRRELTLTVLDIVSLFPNYDSRTYPIRTVSQLTREIYTNPVLENFDGSFRGMAQRIEQNIRQPHLMDLLNSITIYTDVHRGFNYWSGHQITASPVGFAGPEFTFPRYGTMGNAAPPVLISTTGLGIFRTLSSPLYRRIILGSGPNNQNLFVLDGTEFSFASLTADLPSTIYRQRGTVDSLDVIPPQDNSVPARAGFSHRLSHVTMLSQAAGAVYTLRAPTFSWRHRSAEFSNLIPSSQITQIPLTKSINLGSGTSVVKGPGFTGGDILRRTSPGQISTLRVTITAPLSQRYRVRIRYASTTNLQFHTSIDGRPINQGNFSATMSSGGNLQSGSFRTAGFTTPFNFSNGSSIFTLSAHVFNSGNEVYIDRIEFVPAEVTFEAEYDLERAQEAVNALFTSSNQLGLKTNVTDYHIDQVSNLVECLSGEFCLDEKRELSEKVKHAKRLSDERNLLQDPNFRGINRQPDRGWRGSTDITIQGGDDVFKENYVTLPGTFNECYPTYLYQKIDESKLKAYTRYQLRGYIEDSQDLEIYLIRYNTKHETVNVPGTGSLWPLSVENPIGKCGEPNRCAPQLEWNPDLDCSCRDGEKCAHHSHHFSLDIDIGCTDLNENLGVWVIFKIKTQDGHARLGNLEFLEEKPLVGESLARVKRAEKKWRDKREKLQVQTNIVYKEAKESVDALFVNSQYDRLQADTDIAMIHAADKRVHRIREAYLPELSVIPGVNAGIFEELEGRIFTAYSLYDARNLIKNGDFNNGLSCWNVKGHVDVEEQNNHRSVLVVPEWEAEVSQEVRVCPGRGYILRVTAYKEGYGEGCVTIHEIEDNTDELKFSNCVEEEVYPNNTVTCNDYTANQEQYGGAYTSRNRGYGESYESNSSIPAEYAPVYEEAYIDGRKENPCESNRGYGDYTPLPAGYVTKELEYFPETDKVWIEIGETEGTFIVDSVELLLMEE

SEQ ID NO: 129 - protein, 1181 aa, Bacillus thuringiensis alesti
MDNNPKINECIPYNCLSNPEVEVLGGERIETGYTPIDISLSLTQFLLSEFVPGAGFVLGLIDLIWGFVGPSQWDAFLVQIEQLISQRIEEFARNQAISRLEGLSNLYQIYAEAFREWEADPTNPALREEMRIQFNDMNSALTTAIPLFTVQNYQVPLLSVYVQAVNLHLSVLRDVSVFGQRWGLDVATINSRYNDLTRLIGTYTDYAVRWYNTGLERVWGPDSRDWVRYNQFRRELTLTVLDIVSLFPNYDSRTYPIRTVSQLTREIYTNPVLENFDGSFRGSAQRIEQSIRSPHLMDILNSITIYTDAHGGYYYWSGHQIMASPVGFSGPEFTFPLYGTMGNAAPQQRIVAQLGQGVYRTLSSTFYRNPFIIGINNQRLSVLDGTEFAYGSSSNLPSAVYRKSGTVDSLDEIPPQDNNVPPRQGFSHRLSHVSMFRSGFSNSSVSIIRAPMFSWIHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGGNLQSGSFRTVGFTTPFNFSNGSSVFTLSAHVFNSGNEVYIDRIEFVPAEVTFEAEYDLERAQEAVNALFTSPNQIGLKTDVTDYHIDQVSNLVECLSDEFCLDEKRELSEKVKHAKRLSDERNLLQDPNFRGINRQPDRGWRGSTDITIQGGDDVFKENYVTLPGTFDECYPTYLYQKIDESKLKAYTRYELRGYIEDSQDLEIYLIRYNAKHETVNVPGTGSLWPLSFESSIGKCGEPNRCAPHLEWNPDLDCSCRDGEKCAHHSHHFSLDIDVGCIDLNEDLGVWVIFKIKTQDGHARLGNLEFLEEKPLVGEALARVKRAEKKWRDKREKLQLETNIVYKEAKESVDALFVNSQYDQLQADTNIAMIHTADKRVHRIQEAYLPELSVIPGVNAGIFEELEGRIFTAYSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNEYTANQEEYGGAYTSCNRGYDETYGSNYSVPADYASVYEEKAYTDGRRENPCESNRGYGDYTPLPAGYVTKQLEYFPETDKVWIEIGETEGTFIVDSVELFLMEE

SEQ ID NO: 130 - protein, 911 aa, Bacillus thuringiensis NT0423
MDNNPNINECIPYNCLSNPEVEVLGGERIETGYTPIDISLSLTQFLLSEFVPGAGFVLGLVDIIWEIFSVLSSDAFLVQIEQLINQRIEEFARNQAISRLEGLSNLYQIYAESFREWEADPTNPALREEMRIQFNDMNSALTTAIPLFAVQNYQVPLLSVYVTCNYIISSESVMCGQRSGFDAATINSRYNDLTRLIGNYTDHAVRWYNTGLERVWGPDSRDWIRYNQFRRELTLTVLDIVSLFPNYDSRTYPIRTVSQLTREIYTNPVLENFDGSFRGSAQGIEGSIRSPHLMDILNSITIYTDAHRGEYYWSGHQIMASPVGFSGPEFTFPLYGTMGNSAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIPSSQITQIPLTKSTNLGSGTSVVKGPGFTGGDILRRTSPGQISTLRVNITAPLSQRYRVRILYASTTNLQFHTSIDGRPINQGNFSATMSSGRNLQSGSLRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKKELSEKVKHAKRLSDERNLLQDPNFRGINRQLDRGWRRSTDITTQGGDDFFQENYVTLLGTLMGFPSIYIKKWWFEIKSLYPLPIRGYIEDSQDLEIYLIRYNAKHETVNVPGTVPYGRFQPQVPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREA

SEQ ID NO: 131 - protein, 1176 aa, Bacillus thuringiensis
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFSNYDSRRYPIRTVSQLTREIYTNPVLENFDGSFRGMAQRIEPEYRQPHLMDILNSISIYTDVHRGFNYWSGHQITTSPVGFSGPEFTFPLYGTYGNAAPPQRIAQTGLGIFRTLSSPLYRRIILGSGPNNQELFVLDGTEFSFASLTTNLPSTIYRQRGTVDSLDVIPPQDNSVPPRAGFSHRLSHVPMLSQAAGAVYTLRASLFLLLVLLIHARSIFNNIIPSSQITQSFKKIISWTSVVKGPGFTGGDILRRPSPGLISTLRVNITAPLSQRYRVRIRYAFTTNLQFLTSIDGRPINQGNFYATMSSGSNLQSGSFRTVGFTTPFNFSNGSSVFTLSAHVFNSGNEVYIDRIEFVPAEVTFEAEYDLERAQNGVNQLFTSSNQIGLKTDGTDYHIDQVSNLVECLSDEFCLDEKQELSEKVKHAKRLSDERNLLQDPNFRGINRQLDRGWRGSHDITIQGGDDVFKENYVTLLGTFDECYPTYLYQKIDQSKLKAYTSYQLRGYIEDSQDLEIYLIGYNAKQQTVNVPGTGSLWPVYAPKPIGKCGEPNRCAPHLEWNPDLDCSCRDGEKCAHHSLHFSIDIDVGCTDLNEDLGVWVIFKIKTEDGHARLGNLEFLEEKPLVGEALARVKRAEKKWRDKRVKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYFPRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTGLPVGYVTKALEYFPETDKVWIEIGETEGTFIVDSVELLLMEE

SEQ ID NO: 132 - protein, 1182 aa, Bacillus thuringiensis
MKNSIKLSELWYFNERKWRYFMEIVNNQNQCVPYNCLNNPEIEILEGGRISVGNTPIDISLSLTQFLLSEFVPGAGFVLGLIDLIWGFVGPSQWDAFLAQVEQLINQRIAEAVRNTAIQELEGMARVYRTYATAFAEWEKAPDDPELREALRTQFTATETYISGRISVLKIQTFEVQLLSVFAQAANLHLSLLRDVVFFGQRWGFSTTTVNNYYNDLTEGISTYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTFYRRPFNIGINNQQLSVLDGTEFAYGTSSNLPSAVYRKSGTVDSLDEIPPQNNNVPPRQGFSHRLSHVSMFRSGSSSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTCLSDEFCLDEKRELSEKVKHAKRLSDERNLLQDSNFKDINRQPERGWGGSTGITIQGVDDVFKENYVTLSGTFDECYPTYLYQKIDESKLKAFTRYQLRGYIEDSQDLEVYLIRYNAKHETLNVPGTGSLWPLAVKSPIGRCGEPNRCAHHSHHFSLDIDVGCTDLNEDLGVWVIFKIKTQDGHAKIGNLEFLEEKLLLGEALARVKKAEKKWRDKREKLEWETNIVYKEAKESVDALFVDSQYNRLQTDTNIAMIHAADKRVHRIREAYLPELSVIPGVNAAIFEELEGLIFTAFSLYDARNVIKNGDFNYGLSCWNVKGHVDVEEQNNHRSVLVIPEWEAEVSQEVRVCPGRGYILRVTAYKEGYGEGCVTIHEIEDNTDELKFSNCVEEEVYPNNTVTCNDYTATQEEYEGTYTSRNRGYDGAYESNSSVPADYASAYEEKAYTDGRRDNPCESNRGYRDYTPLPAGYVTKELEYFPETDKVWIEIGETEGTFIVDSVELLLMEE

SEQ ID NO: 133 - protein, 850 aa, Bacillus thuringiensis alesti
MEIVNNQNQCVPYNCLNNPEIEILEGGRISVGNTPIDISLSLTQFLLSEFVPGAGFVLGLIDLIWGFVGPSQWDAFLAQVEQLINQRIAEAVRNTAIQELEGMARVYRTYATAFAEWEKAPDDPELREALRTQFTATETYISGRISVLKIQTFEVQLLSVFAQAANLHLSLLRDVVFFGQRWGFSTTTVNNYYNDLTEGISTYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTFYRRPFNIGINNQQLSVLDGTEFAYGTSSNLPSAVYRKSGTVDSLDEIPPQNNNVPPRQGFSHRLSHVSMFRSGSSSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTCLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEVYLIRYNAKHETLNVPGTGSLWPLAVKSPIGRCGEPNRCAHHSHHFSLDIDVGCTDLNEDLGVWVIFKIKTQDGHAKIGNLEFLEEKL

SEQ ID NO: 134 - protein, 1181 aa, Bacillus thuringiensis
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFSNYDSRRYPIRTVSQLTREIYTNPVLENFDGSFRGMAQRIEQNIRQPHLMDILNSITIYTDVHRGFNYWSGHQITASPVGFSGPEFAFPLFGNAGNAAPPVLVSLTGLGIFRTLSSPLYRRIILGSGPNNQELFVLDGTEFSFASLTTNLPSTIYRQRGTVDSLDVIPPQDNSVPPRAGFSHRLSHVTMLSQAAGAVYTLRAPTFSWQHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTCLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEVYLIRYNAKHETLNVPGTGSLWPLAVKSPIGRCGEPNRCAPRIEWKPDVDCSCRDGEKCAHHSHHFSLDIDVGCTDLNEDLGVWVIFKIKTQDGHAKIGNLEFLEEKLLLGEALARVKKAEKKWRDKREKLEWETNIVYKEAKESVDALFVDSQYNRLQTDTNIAMIHAADKRVHRIREAYLPELSVIPGVNAAIFEELEGLIFTAFSLYDARNVIKNGDFNYGLSCWNVKGHVDVEEQNNHRSVLVIPEWEAEVSQEVRVCPGRGYILRVTAYKEGYGEGCVTIHEIEDNTDELKFSNCVEEEVYPNNTVTCNDYTATQEEYEGTYTSRNRGYDGAYESNSSVPADYASAYEEKAYTDGRRDNPCESNRGYRDYTPLPAGYVTKELEYFPETDKVWIEIGETEGTFIVDSVELLLMEE

SEQ ID NO: 135 - protein, 1155 aa, Bacillus thuringiensis kunthala nags3
MDNNPNINECIPYNCLSNPEVEVLGGERIETGYTPIDISLSLTQFLLSEFVPGAGFVLGLVDIIWGIFGPSQWDAFLVQIEQLINQRIENSLGTKPFLDWKAKQSLSNLRRIFREWEADPTNPALREEMRIQFNARTSALTTAIPLFAVQNYQVPLLSVYVQAANLMFSTRRVQPFSRVVAVTPGYQSRYNFKRCYWGAREFLEDVGAIRDKSNFKKEDSKQLCCYLGIFRLSSYFFKIYEKFRTRVYPISESKFSPINKRNLYKPSIKKFSMVVFEARLRARRKYWSPHLWIYLNQDNHLTDVHRGFNYWSGHQIIASPVGFQDPEFAFPLFGNAGNAAPPVRIVYQLGQGVYRTLSSTLYEDLFIRDKVINTYLFLAGSNLLMEPPHICHPGRYRKSGTVDSLDEIPHQNNNVPPRQGFSHRLSHVSMFRSGFSNSSVSIIRAPMFSWILRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSASFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKQELSEKVKHAKRLSDERNLLQDPNFRGINRQLDRGWRGSTDITIQGGDDVFKENYVTLLGTFDECYPTYLYQKIDESKLKAYTRYQLRGYIEDSQDLESIYIRESVESESVDAPRMESDLRLFGRDGQKMCPSFPSFLLRHYVGCTDLNEDLGVWVIFKIKTQDGHARLGNLEFLEEKPLVGEALARVKRAEKKWRDKREKLEWETNIVYKEAKESVHALFVNSQYDQLQAETNIAMIHAADKRVHSIRKAYLPELAVIPGVNAGIFEELEGRIFTAFSLYDARNVIKNGAFEYMAYPAGTERACRCRRTKQPPFGPCCSGMGSRSVTRSSCLSGSWLYPSCHSVQGGIGEGCVTIHEIENNTDELKFSNCVEEEVYPNNTVTCKIILRLKKNRRVPYTSRNRGYDGAYESNSSVQLIMHQPMKKKHIQMDEETILVNLTEDMGITHHYQRGYVTKELEYFQKPIRYGLRSEKRKEHSSWTAWNYFLWRNNICFIM

SEQ ID NO: 136 - protein, 1228 aa, Bacillus thuringiensis thuringiensis HD2
MTSNRKNENEIINAVSNHSAQMDLLPDARIEDSLCIAEGNNIDPFVSASTVQTGINIAGRILGVLGVPFAGQLASFYSFLVGELWPRGRDQWEIFLEHVEQLINQQITENARNTALARLQGLGDSFRAYQQSLEDWLENRDDARTRSVLYTQYIALELDFLNAMPLFAIRNQEVPLLMVYAQAANLHLLLLRDASLFGSEFGLTSQEIQRYYERQVERTRDYSDYCVEWYNTGLNSLRGTNAASWVRYNQFRRDLTLGVLDLVALFPSYDTRTYPINTSAQLTREVYTDAIGATGVNMASMNWYNNNAPSFSAIEAAAIRSPHLLDFLEQLTIFSASSRWSNTRHMTYWRGHTIQSRPIGGGLNTSTHGATNTSINPVTLRFASRDVYRTESYAGVLLWGIYLEPIHGVPTVRFNFTNPQNISDRGTANYSQPYESPGLQLKDSETELPPETTERPNYESYSHRLSHIGIILQSRVNVPVYSWTHRSADRTNTIGPNRITQIPMVKASELPQGTTVVRGPGFTGGDILRRTNTGGFGPIRVTVNGPLTQRYRIGFRYASTVDFDFFVSRGGTTVNNFRFLRTMNSGDELKYGNFVRRAFTTPFTFTQIQDIIRTSIQGLSGNGEVYIDKIEIIPVTATFEAEYDLERAQEAVNALFTNTNPRRLKTDVTDYHIDQVSNLVACLSDEFCLDEKRELLEKVKYAKRLSDERNLLQDPNFTSINKQPDFISTNEQSNFTSIHEQSEHGWWGSENITIQEGNDVFKENYVTLPGTFNECYPTYLYQKIGESELKAYTRYQLRGYIEDSQDLEIYLIRYNAKHETLDVPGTESLWPLSVESPIGRCGEPNRCAPHFEWNPDLDCSCRDGEKCAHHSHHFSLDIDVGCTDLHENLGVWVVFKIKTQEGHARLGNLEFIEEKPLLGEALSRVKRAEKKWRDKREKLQLETKRVYTEAKEAVDALFVDSQYDRLQADTNIGMIHAADKLVHRIREAYLSELPVIPGVNAEIFEELEGHIITAISLYDARNVVKNGDFNNGLTCWNVKGHVDVQQSHHRSDLVIPEWEAEVSQAVRVCPGCGYILRVTAYKEGYGEGCVTIHEIENNTDELKFKNREEEEVYPTDTGTCNDYTAHQGTAGCADACNSRNAGYEDAYEVDTTASVNYKPTYEEETYTDVRRDNHCEYDRGYVNYPPVPAGYVTKELEYFPETDTVWIEIGETEGKFIVDSVELLLMEE

SEQ ID NO: 137 - protein, 1228 aa, Bacillus thuringiensis entomocidus HD110
MTSNRKNENEIINAVSNHSAQMDLLPDARIEDSLCIAEGNNIDPFVSASTVQTGINIAGRILGVLGVPFAGQLASFYSFLVGELWPRGRDQWEIFLEHVEQLINQQITENARNTALARLQGLGDSFRAYQQSLEDWLENRDDARTRSVLHTQYIALELDFLNAMPLFAIRNQEVPLLMVYAQAANLHLLLLRDASLFGSEFGLTSQEIQRYYERQVERTRDYSDYCVEWYNTGLNSLRGTNAASWVRYNQFRRDLTLGVLDLVALFPSYDTRTYPINTSAQLTREVYTDAIGATGVNMASMNWYNNNAPSFSAIEAAAIRSPHLLDFLEQLTIFSASSRWSNTRHMTYWRGHTIQSRPIGGGLNTSTHGATNTSINPVTLRFASRDVYRTESYAGVLLWGIYLEPIHGVPTVRFNFTNPQNISDRGTANYSQPYESPGLQLKDSETELPPETTERPNYESYSHRLSHIGIILQSRVNVPVYSWTHRSADRTNTIGPNRITQIPMVKASELPQGTTVVRGPGFTGGDILRRTNTGGFGPIRVTVNGPLTQRYRIGFRYASTVDFDFFVSRGGTTVNNFRFLRTMNSGDELKYGNFVRRAFTTPFTFTQIQDIIRTSIQGLSGNGEVYIDKIEIIPVTATFEAEYDLERAQEAVNALFTNTNPRRLKTDVTDYHIDQVSNLVACLSDEFCLDEKRELLEKVKYAKRLSDERNLLQDPNFTSINKQPDFISTNEQSNFTSIHEQSEHGWWGSENITIQEGNDVFKENYVTLPGTFNECYPTYLYQKIGESELKAYTRYQLRGYIEDSQDLEIYLIRYNAKHETLDVPGTESLWPLSVESPIGRCGEPNRCAPHFEWNPDLDCSCRDGEKCAHHSHHFSLDIDVGCTDLHENLGVWVVFKIKTQEGHARLGNLEFIEEKPLLGEALSRVKRAEKKWRDKREKLQLETKRVYTEAKEAVDALFVDSQYDRLQADTNIGMIHAADKLVHRIREAYLSELPVIPGVNAEIFEELEGHIITAISLYDARNVVKNGDFNNGLTCWNVKGHVDVQQSHHRSDLVIPEWEAEVSQAVRVCPGCGYILRVTAYKEGYGEGCVTIHEIENNTDELKFKNREEEEVYPTDTGTCNDYTAHQGTAGCADACNSRNAGYEDAYEVDTTASVNYKPTYEEETYTDVRRDNHCEYDRGYVNYPPVPAGYVTKELEYFPETDTVWIEIGETEGKFIVDSVELLLMEE

SEQ ID NO: 138 - protein, 1228 aa, Bacillus thuringiensis
MTSNRKNENEIINAVSNHSAQMDLLPDARIEDSLCIAEGNNIDPFVSASTVQTGINIAGRILGVLGVPFAGQLASFYSFLVGELWPRGRDQWEIFLEHVEQLINQQITENARNTALARLQGLGDSFRAYQQSLEDWLENRDDARTRSVLYTQYIALELDFLNAMPLFAIRNQEVPLLMVYAQAANLHLLLLRDASLFGSEFGLTSQEIQRYYERQVERTRDYSDYCVEWYNTGLNSLRGTNAASWVRYNQFRRDLTLGVLDLVALFPSYDTRTYPINTSAQLTREVYTDAIGATGVNMASMNWYNNNAPSFSAIEAAAIRSPHLLDFLEQLTIFSASSRWSNTRHMTYWRGRTIQSRPIGGGLNTSTHGATNTSINPVTLRFASRDVYRTESYAGVLLWGIYLEPIHGVPTVRFNFTNPQNISDRGTANYSQPYESPGLQLKDSETELPPETTERPNYESYSHRLSHIGIILQSRVNVPVYSWTHRSADRTNTIGPNRITQIPMVKASELPQGTTVVRGPGFTGGDILRRTNTGGFGPIRVTVNGPLTQRYRIGFRYASTVDFDFFVSRGGTTVNNFRFLRTMNSGDELKYGNFVRRAFTTPFTFTQIQDIIRTSIQGLSGNGEVYIDKIEIIPVTATFEAEYDLERAQEAVNALFTNTNPRRLKTDVTDYHIDQVSNLVACLSDEFCLDEKRELLEKVKYAKRLSDERNLLQDPNFTSINKQPDFISTNEQSNFTSIHEQSEHGWWGSENITIQEGNDVFKENYVTLPGTFNECYPTYLYQKIGESELKAYTRYQLRGYIEDSQDLEIYLIRYNAKHETLDVPGTESLWPLSVESPIGRCGEPNRCAPHFEWNPDLDCSCRDGEKCAHHSHHFSLDIDVGCTDLHENLGVWVVFKIKTQEGHARLGNLEFIEEKPLLGEALSRVKRAEKKWRDKREKLQLETKRVYTEAKEAVDALFVDSQYDRLQADTNIGMIHAADKLVHRIREAYLSELPVIPGVNAEIFEELEGHIITAISLYDARNVVKNGDFNNGLTCWNVKGHVDVQQSHHRSDLVIPEWEAEVSQAVRVCPGCGYILRVTAYKEGYGEGCVTIHEIENNTDELKFKNREEEEVYPTDTGTCNDYTAHQGTAGCADACNSRNAGYEDAYEVDTTASVNYKPTYEEETYTDVRRDNHCEYDRGYVNYPPVPAGYVTKELEYFPETDTVWIEIGETEGKFIVDSVELLLMEE

SEQ ID NO: 139 - protein, 1228 aa, Bacillus thuringiensis entomocidus HD9; identical to SEQ ID NO: 137

SEQ ID NO: 140 - protein, 1228 aa, Bacillus thuringiensis sfw-12; identical to SEQ ID NO: 136

SEQ ID NO: 141 - protein, 1228 aa, Bacillus thuringiensis S601
MTSNRKNENEIINAVSNHSAQMDLLPDARIEDSLCIAEGNNIDPFVSASTVQTGINIAGRILGVLGVPFAGQLASFYSFLVGELWPRGRDQWEIFLEHVEQLINQQITENARNTALARLQGLGDSFRAYQQSLEDWLENRDDARTRSVLYTQYIALELDFLNAMPLFAIRNQEVPLLMVYAQAANLHLLLLRDASLFGSEFGLTSQEIQRYYERQVERTRDYSDYCVEWYNTGLNSLRGTNAASWVRYNQFRRGLTLGVLGLVALFPSYDTRTYPINTSAQLTREVYTDAIGATGVNMASMNWYNNNAPSFSAIEAAAIRSPHLLDFLEQLTIFSASSRWSNTRHMTYWRGHTIQSRPIGGGLNTSTHGATNTSINPVTLRFASRDVYRTESYAGVLLWGIYLEPIHGVPTVRFNFTNPQNISDRGTANYSQPYESPGLQLKDSETELPPETTERPNYESYSHRLSHIGIILQSRVNVPVYSWTHRSADRTNTIGPNRITQIPMVKASELPQGTTVVRGPGFTGGDILRRTNTGGFGPIRVTVNGPLTQRYRIGFRYASTVDFDFFASRGGTTVNNFRFLRTMNSGDELKYGNFVRRAFTTPFTFTQIQNIIRTSIQGLSGNGEVYIDKIEIIPVTATFEAEYDLERAQEAVNALFTNTNPRRLKTDVTDYHIDQVSNLVACLSDEFCLDEKRELLEKVKYAKRLSDERNLLQDPNFTSINKQPDFISTNEQSNFTSIHEQSEHGWWGSENITIQEGNDVSKENYVTLPGTFNECYPTYLYQKIGESELKAYTRYQLEGYIEDSQDLEIYLIRYNAKHETLDVPGTESLWPLSVESPIGRCGEPNRCAPHFEWNPDLDCSCRDGEKCAHHSHHFSLDIDVGCTDLHENLGVWVVFKIKTQEGHARLGNLEFIEEKPLLGEALSRVKRAEKKWRDKREKLQLETKRVYTEAKEAVDALFVDSQYDRLQADTNIGMIHAADKLVHRIREAYLSELPVIPGVNAEIFEELEGHIITAISLYDARNVVKNGDFNNGLTCWNVKGHVDVQQSHHRSDLVIPEWEAEVSQAVRVCPGCGYILSVTAYKEGYGEGCVTIHEIENNTDELKFKNREEEEVYPTDTGTCNDYTAHQGTAGCADACNSRNAGYEDAYEVDTTASVNYKPTYEEETYTDVRRDNHCEYDRGYVNYPPVPAGYVTKELEYFPETDTVWIEIGETEGKFMVDSVELLLMEE

SEQ ID NO: 142 - protein, 1229 aa, Bacillus thuringiensis EG5847
MTSNRKNENEIINALSIPTVSNPSTQMNLSPDARIEDSLCVAEVNNIDPFVSASTVQTGINIAGRILGVLGVPFAGQLASFYSFLVGELWPSGRDPWEIFLEHVEQLIRQQVTENTRNTAIARLEGLGRGYRSYQQALETWLDNRNDARSRSIILERYVALELDITTAIPLFRIRNEEVPLLMVYAQAANLHLLLLRDASLFGSEWGMASSDVNQYYQEQIRYTEEYSNHCVQWYNTGLNNLRGTNAESWLRYNQFRRDLTLGVLDLVALFPSYDTRTYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTQGLTNNTSINPVTLQFTSRDVYRTESNAGTNILFTTPVNGVPWARFNFINPQNIYERGATTYSQPYQGVGIQLFDSETELPPETTERPNYESYSHRLSHIGLIIGNTLRAPVYSWTHRSADRTNTIGPNRITQIPLVKALNLHSGVTVVGGPGFTGGDILRRTNTGTFGDIRLNINVPLSQRYRVRIRYASTTDLQFFTRINGTTVNIGNFSRTMNRGDNLEYRSFRTAGFSTPFNFLNAQSTFTLGAQSFSNQEVYIDRVEFVPAEVTFEAEYDLERAQKAVNALFTSTNPRRLKTDVTDYHIDQVSNMVACLSDEFCLDEKRELFEKVKYAKRLSDERNLLQDPNFTFISGQLSFASIDGQSNFPSINELSEHGWWGSANVTIQEGNDVFKENYVTLPGTFNECYPNYLYQKIGESELKAYTRYQLRGYIEDSQDLEIYLIRYNAKHETLDVPGTDSLWPLSVESPIGRCGEPNRCAPHFEWNPDLDCSCRDGERCAHHSHHFTLDIDVGCTDLHENLGVWVVFKIKTQEGYARLGNLEFIEEKPLIGEALSRVKRAEKKWRDKREKLQLETKRVYTEAKEAVDALFVDSQYDQLQADTNIGMIHAADKLVHRIREAYLSELPVIPGVNAEIFEELEGHIITAMSLYDARNVVKNGDFNNGLTCWNVKGHVDVQQSHHRSDLVIPEWEAEVSQAVRVCPGRGYILRVTAYKEGYGEGCVTIHEIENNTDELKFKNCEEEEVYPTDTGTCNDYTAHQGTAACNSRNAGYEDAYEVDTTASVNYKPTYEEETYTDVRRDNHCEYDRGYVNYPPVPAGYVTKELEYFPETDTVWIEIGETEGKFIVDSVELLLMEE

SEQ ID NO: 143 - protein, 1233 aa, Bacillus thuringiensis morrisoni
MTSNRKNENEIINALSIPTVSNPSTQMNLSPDARIEDSLCVAEVNNIDPFVSASTVQTGINIAGRILGVLGVPFAGQLASFYSFLVGELWPSGRDPWEIFLEHVEQLIRQQVTENTRNTAIARLEGLGRGYRSYQQALETWLDNRNDARSRSIILERYVALELDITTAIPLFRIRNEEVPLLMVYAQAANLHLLLLRDASLFGSEWGMASSDVNQYYQEQIRYTEEYSNHCVQWYNTGLNNLRGTNAESWLRYNQFRRDLTLGVLDLVALFPSYDTRTYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTQGLTNNTSINPVTLQFTSRDVYRTESNAGTNILFTTPVNGVPWARFNFINPQNIYERGATTYSQPYQGVGIQLFDSETELPPETTERPNYESYSHRLSHIGLIIGNTLRAPVYSWTHRSADRTNTIGPNRITQIPLVKALNLHSGVTVVGGPGFTGGDILRRTNTGTFGDIRLNINVPLSQRYRVRIRYASTTDLQFFTRINGTTVNIGNFSRTMNRGDNLEYRSFRTAGFSTPFNFLNAQSTFTLGAQSFSNQEVYIDRVEFVPAEVTFEAEYDLERAQKAVNALFTSTNPRRLKTDVTDYHIDQVSNMVACLSDEFCLDEKRELFEKVKYAKRLSDERNLLQDPNFTFISGQLSFASIDGQSNFPSINELSEHGWWGSANVTIQEGNDVFKENYVTLPGTFNECYPNYLYQKIGESELKAYTRYQLRGYIENSQDLEIYLIRYNAKHEAINVPGTESIWSISAESTIGKCTEPNRCAPHYEWNPDLDCSCRDGEKCAHHSHHSTLDIDVGCTDLHENLGVWLIFKIKTQDGHARLGNLEYLEEKPLLGEALRRVKRTEKKWRDKREKLHLETKRVYTEAKESVDALFVDSQYDRLQANSNIGMIHAADKLVHSIREAYLSELPVIRGVNADIFEELEGHILTAFSLYDARNAVKNGDFNNGLTCWNVKGHVDVQQSHHRFDLVVPEWKAEVSQAVRVCPGCGYILRVTAYKEGYGEGCVTIHEIEENTDELNFKNRVEEEIYPPDTGTCKYYTENQGTRTCGNECGSRNEGYDNAYEINAKSSLEYRPTYEEETYTDVRRENHCEYARGYINYSPVPAGYVTKELEYFPETDTVWIEIGETEGKFIVDSVELLLMEE

SEQ ID NO: 144 - protein, 1231 aa, Bacillus thuringiensis wuhanensis HD525
MTSNRKNENEIINALSIPAVSNHSAQMDLSLDARIEDSLCIAEGNNINPLVSASTVQTGINIAGRILGVLGVPFAGQLASFYSFLVGELWPSGRDPWEIFLEHVEQLIRQQVTENTRNTAIARLEGLGRGYRSYQQALETWLDNRNDARSRSIILERYVALELDITTAIPLFRIRNEEVPLLMVYAQAANLHLLLLRDASLFGSEWGMASSDVNQYYQEQIRYTEEYSNHCVQWYNTGLNNLRGTNAESWLRYNQFRRDLTLGVLDLVALFPSYDTRTYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTQGLTNNTSINPVTLQFTSRDVYRTESNAGTNILFTTPVNGVPWARFNFINPQNIYERGATTYSQPYQGVGIQLFDSETELPPETTERPNYESYSHRLSHIGLIIGNTLRAPVYSWTHRSADRTNTIGPNRITQIPAVKGRFLFNGSVISGPGFTGGDVVRLNRNNGNIQNRGYIEVPIQFTSTSTRYRVRVRYASVTSIELNVNLGNSSIFTNTLPATAASLDNLQSGDFGYVEINNAFTSATGNIVGARNFSANAEVIIDRFEFIPVTATFEAEYDLERAQKAVNALFTSTNPRRLKTDVTDYHIDQVSNMVACLSDEFCLDEKRELFEKVKYAKRLSDERNLLQDPNFTFISGQLSFASIDGQSNFTSINELSEHGWWGSENVTIQEGNDVFKENYVTLPGTFNECYPNYLYQKIGESELKAYTRYQLRGYIEDSQDLEIYLIRYNAKHETLDVPGTDSLWPLSVKSPIGRCGEPNRCAPHFEWNPDLDCSCRDGERCAHHSHHFTLDIDVGCTDLHENLGVWVVFKIKTQEGYARLGNLEFIEEKPLIGEALSRVKRAEKKWRDKREKLQLETKRVYTEAKETVDALFVDSHYNRLQADTNIGMIHAADRLVHRIHEAYLPELPFIPGINAVIFEELENRISTAFSLYDARNVIKNGDFNNGLSCWNVKGHVDVQQSHHRSDLVIPEWEAEVSQAVRVCPGRGYILRVTAYKEGYGEGCVTIHEIENNTDELKFKNCEEEEVYPTDTGTCNDYTAHQGTAACNSRNAGYEDAYEVDTTASVNYKPTYEEETYTDVRRDNHCEYDRGYVNYPPVPAGYVTKELEYFPETDTVWIEIGETEGKFIVDSVELLLMEE

SEQ ID NO: 145 - protein, 1231 aa, Bacillus thuringiensis 834
MTSNRKNENEIINALSIPTVSNPSTQMNLSPDARIEDSLCVAEVNNIDPFVSASTVQTGINIAGRILGVLGVPFAGQLASFYSFLVGELWPSGRDPWEIFLEHVEQLIRQQVTENTRNTAIARLEGLGRGYRSYQQALETWLDNRNDARSRSIILERYVALELDITTAIPLFRIRNEEVPLLMVYAQAANLHLLLLRDASLFGSEWGMASSDVNQYYQEQIRYTEEYSNHCVQWYNTGLNNLRGTNAESWLRYNQFRRDLTLGVLDLVALFPSYDTRTYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTQGLTNNTSINPVTLQFTSRDVYRTESNAGTNILFTTPVNGVPWDRFNFINPQNIYERGATTYSQPYQGVGIQLFDSETELPPETTERPNYESYSHRLSHIGLIIGNTLRAPVYSWTHRSADRTNTIGPNRITQIPAVKGRFLFNGSVISGPGFTGGDVVRLNRNNGNIQNRGYIEVPIQFTSTSTRYRVRVRYASVTSIELNVNLGNSSIFTNTLPATAASLDNLQSGDFGYVEINNAFTSATGNIVGARNFSANAEVIIDRFEFIPVTATFEAEYDLERAQKAVNALFTSTNPRRLKTDVTDYHIDQVSNMVACLSDEFCLDEKRELFEKVKYAKRLSDERNLLQDPNFTFISGQLSFASIDGQSNFTSINELSEHGWWGSENVTIQEGNDVFKENYVTLPGTFNECYPNYLYQKIGESELKAYTRYQLRGYIEDSQDLEIYLIRYNAKHETLDVPGTDSLWPLSVKSPIGRCGEPNRCAPHFEWNPDLDCSCRDGERCAHHSHHFTLDIDVGCTDLHENLGVWVVFKIKTQEGYARLGNLEFIEEKPLIGEALSRVKRAEKKWRDKREKLQLETKRVYTEAKETVDALFVDSHYNRLQADTNIGMIHAADRLVHRIHEAYLPELPFIPGINAVIFEELENRISTAFSLYDARNVIKNGDFNNGLSCWNVKGHVDVQQSHHRSDLVIPEWEAEVSQAVRVCPGRGYILRVTAYKEGYGEGCVTIHEIENNTDELKFKNCEEEEVYPTDTGTCNDYTAHQGTAACNSRNAGYEDAYEVDTTASVNYKPTYEEETYTDVRRDNHCEYDRGYVNYPPVPAGYVTKELEYFPETDTVWIEIGETEGKFIVDSVELLLMEE

SEQ ID NO: 146 - protein, 1227 aa, Bacillus thuringiensis PS158C2
MTSNRKNENEIINALSIPAVSNHSAQMNLSTDARIEDSLCIAEGNNIDPFVSASTVQTGINIAGRILGVLGVPFAGQIASFYSFLVGELWPRGRDPWEIFLEHVEQLIRQQVTENTRDTALARLQGLGNSFRAYQQSLEDWLENRDDARTRSVLYTQYIALELDFLNAMPLFAIRNQEVPLLMVYAQAANLHLLLLRDASLFGSEFGLTSQEIQRYYERQVEKTREYSDYCARWYNTGLNNLRGTNAESWLRYNQFRRDLTLGVLDLVALFPSYDTRVYPMNTSAQLTREIYTDPIGRTNAPSGFASTNWFNNNAPSFSAIEAAVIRPPHLLDFPEQLTIFSVLSRWSNTQYMNYWVGHRLESRTIRGSLSTSTHGNTNTSINPVTLQFTSRDVYRTESFAGINILLTTPVNGVPWARFNWRNPLNSLRGSLLYTIGYTGVGTQLFDSETELPPETTERPNYESYSHRLSNIRLISGNTLRAPVYSWTHRSADRTNTISSDSITQIPLVKSFNLNSGTSVVSGPGFTGGDIIRTNVNGSVLSMGLNFNNTSLQRYRVRVRYAASQTMVLRVTVGGSTTFDQGFPSTMSANESLTSQSFRFAEFPVGISASGSQTAGISISNNAGRQTFHFDKIEFIPITATFEAEYDLERAQEAVNALFTNTNPRRLKTGVTDYHIDEVSNLVACLSDEFCLDEKRELLEKVKYAKRLSDERNLLQDPNFTSINKQPDFISTNEQSNFTSIHEQSEHGWWGSENITIQEGNDVFKENYVILPGTFNECYPTYLYQKIGEAELKAYTRYQLSGYIEDSQDLEIYLIRYNAKHETLDVPGTESVWPLSVESPIGRCGEPNRCAPHFEWNPDLDCSCRDGEKCAHHSHHFSLDIDVGCIDLHENLGVWVVFKIKTQEGHARLGNLEFIEEKPLLGEALSRVKRAEKKWRDKREKLQLETKRVYTEAKEAVDALFVDSQYDRLQADTNIGMIHAADKLVHRIREAYLSELSVIPGVNAEIFEELEGRIITAISLYDARNVVKNGDFNNGLACWNVKGHVDVQQSHHRSVLVIPEWEAEVSQAVRVCPGRGYILRVTAYKEGYGEGCVTIHEIENNTDELKFKNCEEEEVYPTDTGTCNDYTAHQGTAACNSRNAGYEDAYEVDTTASVNYKPTYEEETYTDVRRDNHCEYDRGYVNYPPVPAGYMTKELEYFPETDKVWIEIGETEGKFIVDSVELLLMEE

SEQ ID NO: 147 - protein, 1227 aa, Bacillus thuringiensis
LTSNRKNENEIINALSIPAVSNHSAQMNLSTDARIEDSLCIAEGNNIDPFVSASTVQTGINIAGRILGVLGVPFAGQIASFYSFLVGELWPRGRDPWEIFLEHVEHLIRQQVTENTRDTALARLQGLGNSFRAYQQSLEDWLENRDDARTRSVLYTQYIALELDFLNAMPLFAIRNQEVPLLMVYAQAANLHLLLLRDASLFGSEFGLTSQEIQRYYERQVEKTREYSDYCARWYNTGLNNLRGTNAESWLRYNQFRRDLTLGVLDLVALFPSYDTRVYPMNTSAQLTREIYTDPIGRTNAPSGFASTNWFNNNAPSFSAIEAAVIRPPHLLDFPEQLTIFSVLSRWSNTQYMNYWVGHRLESRTIRGSLSTWTHGNTNTSINPVTLQFTSRDVYRTESFAGINILLTTPVNGVPWARFNWRNPLNSLRGSLLYTIGYTGVGTQLFDSETELPPETTERPNYESYSHRLSNIRLISGNTLRAPVYSWTHRSADRTNTISSDSITQIPLVKSFNLNSGTSVVSGPGFTGGDIIRTNVNGSVLSMGLNFNNTSLQRYRVRVRYAASQTMVLRVTVGGSTTFDQGFPSTMSANESLTSQSFRFAEFPVGISASGSQTAGISISNNAGRQTFHFDKIEFIPITATFEAEYDLERAQEAVNALFTNTNPRRLKTGVTDYHIDEVSNLVACLSDEFCLDEKRELLEKVKYAKRLSDERNLLQDPNFTSINKQPDFNSNNEQSNFTSIHEQSEHGWWGSENITIQEGNDVFKENYVTLPGTFNECYPTYLYQKIGEAELKAYTRYQLSGYIEDSQDLEIYLIRYNAKHETLDVPGTESVWPLSVESPIGRCGEPNRCAPHFEWNPDLDCSCRDGEKCAHHSHHFSLDIDVGCIDLHENLGVWVVFKIKTQEGHARLGNLEFIEEKPLLGEALSRVKRAEKKWRDKREKLQLETKRVYTEAKEAVDALFVDSQYDRLQADTNIGMIHAADKLVHRIREAYLSELSVIPGVNAEIFEELEGRIITAISLYDARNVVKNGDFNNGLACWNVKGHVDVQQSHHRSVLVIPEWEAEVSQAVRVCPGRGYILRVTAYKEGYGEGCVTIHEIENNTDELKFKNCEEEEVYPTDTGTCNDYTAHQGTAVCNSRNAGYEDAYEVDTTASVNYKPTYEEETYTDVRRDNHCEYDRGYVNYPPVPAGYMTKELEYFPETDKVWIEIGETEGKFIVDSVELLLMEE

SEQ ID NO: 148 - protein, 1227 aa, Bacillus thuringiensis g9
MNSNRKNENEIINALSIPAVSNHSAQMNLSTDARIEDSLCIAEGNNIDPFVSASTVQTGINIAGRILGVLGVPFAGQIASFYSFLVGELWPRGRDPWEIFLEHVEQLIRQQVTENTRDTALARLQGLGNSFRAYQQSPEDWLGNRDDARTRSVLYTQYIALELDFLNAMPLFAIRNQEVPLLMVYAQAANLHLLLLRDASLFGSEFGLTSQEIQRYYERQVEKTREYSDYCARWYNTGLNNLRGTNAESWLRYNQFRRDLTLGVLDLVALFPSYDTRVYPMNTSAQLTREIYTDPIGRTNAPSGFASTNWFNNNAPSFSAIEAAVIRPPHLLDFPEQLTIFSVLSRWSNTQYMNYWVGHRLESRTIRGSLSTSTHGNTNTSINPVTLQFTSRDVYRTESLAGINILLTTPVNGVPWARFNWRNPLNSLRGSLLYTIGYTGVGTQLFDSETELPPETTERPNYESYSHRLSNIRLISGNTLRAPVYSWTHRSADRTNTISSDSITQIPLVKSFNLNSGTSVVSGPGFTGGDIIRTNVNGSVLSMGLNFNNTSLQRYRVRVRYAASQTMVLRVTVGGSTTFDQGFPSTMSANESLTSQSFRFAEFPVGISASGSQTAGISISNNAGRQTFHFDKIEFIPITATFEAEYDLERAQEAVNALFTNTNPRRLKTGVTDYHIDEVSNLVACLSDEFCLDEKRELLEKVKYAKRLSDERNLLQDPNFTSINKQPDFISTNEQSNFTSIHEQSEHGWWGSENITIQEGNDVFKENYVTLPGTFNECYPTYLYQKIGESELKAYTRYQLSGYIEDSQDLEIYLIRYNAKHETLDVPGTESVWSLSVESPIGRCGEPNRCAPHFEWNPDLDCSCRDGEKCAHHSHHFSLDIDVGCIDLHENLGVWVVFKIKTQEGHARLGNLEFIEEKPLLGEALSRVKRAEKKWRDKREKLQLETKRVYTEAKEAVDALFVDSQYDRLQADTNIGMIHAADKLVHRTREAYLSELSVIPGVNAEIFEELEGRIITAISLYDARNVVKNGDFNNGLAFWNVKGHVDVQQSHHRSVLVIPEWEAEVSQEVRVCPGRGYILRVTAYKEGYGEGCVTIHEIENNTDELKFKNCEEEEVYPTDTGTCNDYTAHQGTAACNSRNAGYEDAYEVDTTASVNYKPTYEEETYTDVRRDNHCEYDRGYVNYPPLPAGYVTKELEYFPETDKVWIEIGETEGKFIVGSVELLLMEE

SEQ ID NO: 149 - protein, 1228 aa, Bacillus thuringiensis
MTSNRKNENEIINALSIPAVSNHSTQMDLSPDARIEDSLCIAEGNNINPLVSASTVQTGINIAGRILGVLGVPFAGQIASFYSFLVGELWPRGRDQWEIFLEHVEQLINQQITENARNTALARLQGLGDSFRAYQQSLEDWLENRDDARTRSVLYTQYIALELDFLNAMPLFAIRNQEVPLLMVYAQAANLHLLLLRDASLFGSEFGLTSQEIQRYYERQVEQTRDYSDYCVEWYNTGLNSLRGTNAASWVRYNQFRRDLTLGVLDLVALFPSYDTRTYPINTSAQLTREVYTDAIGATGVNMASMNWYNNNAPSFSAIETAVIRSPHLLDFLEQLTIFSTSSRWSATRHMTYWRGHTIQSRPIGGGLNTSTHGSTNTSINPVRLSFFSRDVYWTESYAGVLLWGIYLEPIHGVPTVRFNFRNPQNTFERGTANYSQPYESPGLQLKDSETELPPETTERPNYESYSHRLSHIGLISQSRVHVPVYSWTHRSADRTNTISSDSITQIPLVKSFNLNSGTSVVSGPGFTGGDIIRTNVNGSVLSMGLNFNNTSLQRYRVRVRYAASQTMVLRVTVGGSTTFDQGFPSTMSANESLTSQSFRFAEFPVGISASGSQTAGISISNNAGRQTFHFDKIEFIPITATFEAEYDLERAQEAVNALFTNTNPRRLKTDVTDYHIDQVSNLVACLSDEFCLDEKRELLEKVKYAKRLSDERNLLQDPNFTSINKQPDFISTNEQSNFTSIHEQSEHGWWGSENITIQEGNDVFKENYVTLPGTFNECYPTYLYQKIGESELKAYTRYQLRGYIEDSQDLEIYLIRYNAKHETLDVPGTESVWPLSVESPIGRCGEPNRCAPHFEWNPDLDCSCRDGEKCAHHSHHFSLDIDIGCTDLHENLGVWVVFKIKTQEGHARLGNLEFIEEKPLLGEALSRVKRAEKKWRDKREKLQLETKRVYTEAKEAVDALFVDSQYNRLQADTNIGMIHAADKLVHRIREAYLSELSVIPGVNAEIFEELEGRIITAISLYDARNVVKNGDFNNGLACWNVKGHVDVQQSHHRSVLVIPEWEAEVSQAVRVCPGRGYILRVTAYKEGYGEGCVTIHEIENNTDELKFKNCEEEEVYPTDTGTCNDYTAHQGTAVCNSRNAGYEDAYEVDTTASVNYKPTYEEETYTDVRRDNHCEYDRGYVNYPPLPAGYMTKELEYFPETDKVWIEIGETEGKFIVDSVELLLMEE

SEQ ID NO: 150 - protein, 1228 aa, Bacillus thuringiensis
MTSNRKNENEIINALSIPAVSNHSTQMDLSPDARIEDSLCIAEGNNINPLVSASTVQTGINIAGRILGVLGVPFAGQIASFYSFLVGELWPRGRDQWEIFLEHVEQLINQQITENARNTALARLQGLGDSFRAYQQSLEDWLENRDDARTRSVLYTQYIALELDFLNAMPLFAIRNQEVPLLMVYAQAANLHLLLLRDASLFGSEFGLTSQEIQRYYERQVEQTRDYSDYCVEWYNTGLNSLRGTNAASWVRYNQFRRDLTLGVLDLVALFPSYDTRTYPINTSAQLTREVYTDAIGATGVNMASMNWYNNNAPSFSAIETAVIRSPHLLDFLEQLTIFSTSSRWSATRHMTYWRGHTIQSRPIGGGLNTSTHGSTNTSINPVRLSFFSRDVYWTESYAGVLLWGIYLEPIHGVPTVRFNFRNPQNTFERGTANYSQPYESPGLQLKDSETELPPETTERPNYESYSHRLSHIGLISQSRVHVPVYSWTHRSADRTNTISSDSITQIPLVKSFNLNSGTSVVSGPGFTGGDIIRTNVNGSVLSMGLNFNNTSLQRYRVRVRYAASQTMVLRVTVGGSTTFDQGFPSTMSANESLTSQSFRFAEFPVGISASGSQTAGISISNNAGRQTFHFDKIEFIPITATFEAEYDLERAQEAVNALFTNTNPRRLKTDVTDYHIDQVSNLVACLSDEFCLDEKRELLEKVKYAKRLSDERNLLQDPNFTSINKQPDFISTNEQSNFTSIHEQSEHGWWGSENITIQEGNDVFKENYVTLPGTFNECYPTYLYQKIGESELKAYTRYQLRGYIEDSQDLEIYLIRYNAKHETLDVPGTESVWPLSVESPIGRCGEPNRCAPHFEWNPDLDCSCRDGEKCAHHSHHFSLDIDIGCTDLHENLGVWVVFKIKTQEGHARLGNLEFIEEKPLLGEALSRVKRAEKKWRDKREKLQLETKRVYTEAKEAVDALFVDSQYNRLQADTNIGMIHAADKLVHRIREAYLSELSVIPGVNAEIFEELEGRIITAISLYDARNVVKNGDFNNGLACWNVKGHVDVQQSHHRSVLVIPEWEAEVSQAVRVCPGRGYILRVTAYKEGYGEGCVTIHEIENNTDELKFKNCEEEEVYPTDTGTCNDYTAHQGTAACNSRNAGYEDAYEVDTTASVNYKPTYEEETYTDVRRDNHCEYDRGYVNYPPLPAGYVTKELEYFPETDKVWIEIGETEGTFIVDSIELLLMEE

SEQ ID NO: 151 - protein, 1235 aa, Bacillus thuringiensis
MNSNRKNENEIIDASFIPAVSNESVTISKEYAQTNQLQNNSIEDGLCIAEGEYIDPFVSASTVQTGISIAGRILGVLGVPFAGQLASFYSFIVGELWPKGRDQWEIFMEHVEQLVRQQITANARNTALARLQGLGDSFRAYQQSLEDWLENRNDARTRSVLYTQYIALELDFLNAMPLFAIREQEVPLLMVYAQAANLHLLLLRDASLYGREFGLTSQEIQRYYERQVERTRDYSDHCVQWYNTGLNNLRGTNAESWVRYNQFRRDLTLGVLDLVALFPSYDTRTYPINTSAQLTREVYTDAIGATGVNMASMNWYNNNAPSFSAIETAVIRSPHLLDFLEQLKIFSASSRWSNTRHMTYWRGHTIQSRPIRGALITSTHGNTNTSINPVTFQFPSRDVYRTESYAGVLLWGIYLEPIHGVPTVRFNFRNPQNTFERGTANYSQPYESPGLQLKDSETELPPETTERPNYESYSHRLSHIGIILQTRLNVPVYSWTHRSADRTNTISSDSITQIPLVKSFNLNSGTSVVSGPGFTGGDIIRTNVNGSVLSMGLNFNNTSLQRYRVRVRYAASQTMVLRVTVGGSTTFDQGFPSTMSANESLTSQSFRFAEFPVGISASGSQTAGISISNNAGRQTFHFDKIEFIPITATFEAEYDLERAQEAVNALFTNTNPRRLKTGVTDYHIDEVSNLVACLSDEFCLDEKRELLEKVKYAKRLSDERNLLQDPNFTSINKQPDFISTNEQSNFTSIHEQSEHGWWGSENITIQEGNDVFKENYVTLPGTYNECYPTYLYQKIGESELKAYTRYQLRGYIEDSQDLEIYLIRYNAKHETLDVPGTESVWPLSVESPIRRCGEPNRCAPHFEWNPDLDCSCRDGEKCAHHSHHFSLDIDVGCIDLHENLGVWVVFKIKTQEGHARLGNLEFIEEKPLLGEALSRVKRAEKKWRDKREKLQLETKRVYTEAKEAVDALFVDSQYDRLQADTNIGMIHAADKLVHRIREAYLSELSVIPGVNAEIFEELEGRIITAISLYDARNVVKNGDFNNGLACWNVKGHVDVQQSHHRSVLVIPEWEAEVSQAVRVCPGRGYILRVTAYKEGYGEGCVTIHEIENNTDELKFKNCEEEEVYPTDTGTCNDYTAHQGTAACNSRNAGYEDAYEVDTTASVNYKPTYEEETYTDVRRDNHCEYDRGYVNYPPLPAGYVTKELEYFPETDKVWIEIGETEGTFIVDSIELLLMEE

SEQ ID NO: 152 - protein, 1256 aa, Bacillus thuringiensis PS46L
MTSNRKNENEIINALSIPTVSNPSTQMNLSPDARIEDSLCVAEVNNIDPFVSASTVQTGINIAGRILGVLGVPFAGQLASFYSFLVGELWPSGRDPWEIFLEHVEQLIRQQVTENTRNTAIARLEGLGRGYRSYQQALETWLDNRNDARSRSIILERYVALELDITTAIPLFRIRNQEVPLLMVYAQAANLHLLLLRDASLFGSEWGTASSDVNQYYQEQIRYTEEYSNHCVQWYNTGLNNLRGTNAESWVRYNQFRRDLTLGVLDLVALFPSYDTRTYPINTSAQLTREVYTDAIGTVHPSQAFASTTWFNNNAPSFSAIEAAVIRPPHLLDFPEQLTIYSTLSRWSNTQFMNIWAGHRLESRPIAGSLNTSTQGSTNTSINPVTLQFTSRDIYRTESLAGLNIFITQPVNGVPWVRFNWRNPLNSLRGSLLYTIGYTGVGTQLQDSETELPPETTERPNYESYSHRLSHIGLISSSHVRALVYSWTHRSADRTNTIGPNRITQIPAVKGRFLFNGSVISGPGFTGGDVVRLNRNNGNIQNRGYIEVPIQFTSTSTRYRVRVRYASVTSIELNVNWGNSSIFTNTLPATAASLDNLQSGDFGYVEINNAFTSATGNIVGVRNFSANAEVIIDRFEFIPVTATFEAKYDLERAQKAVNALFTSTNPRRLKTDVTDYHIDQVSNLVVCLSDEFCLDEKRELFEKVKYAKRLSDERNLLQDPNFTFINGQPSFASIDGQSNFTSINELSNHGWWGSANVTIQEGNDVFKENYVTLPGTFNECYPNYLYQKIGESELKAYTRYQLRGYIEDSQDLEIYLIRYNAKHETLNVPGTESLWPLSVESPIGRCGEPNRCAPHFGWNPDLDCSCRDREKCAHHSHHFTLDIDVGCTDLQEDLGVWVVFKIKTQEGYARLGNLEFIEEKPLIGEALSRVKRAEKKWRDKREKLQVETKRVYIDAKEAVDALFVDSQYDRLQADTNIGMIHAADRLVHRIHEAYLPELPFIPGINVVIFEELENRISTAFSLYDARNVIKNGDFNNGLTCWNVKGHVEVQQLNNHRSVLVIPEWEAEVSQKVRVCPGRGYILRVTAYKEGYGEGCVTIHEVDNNTDQLKFSNCEKGQVYPGNTIACNDYNKNHGANACSSRNRGYDEFYGNTPADYSANQKEYGGAYTSHNHAYGESYESNSSIPADYAPVYEEEAYTHGRRGNSCEYNRGYTPLPAGYVTAELEYFPETDTVWVEIGETEGTFIVDNVELLLMEE

SEQ ID NO: 153 - protein, 1189 aa, Bacillus thuringiensis entomocidus 60.5
MEENNQNQCIPYNCLSNPEEVLLDGERISTGNSSIDISLSLVQFLVSNFVPGGGFLVGLIDFVWGIVGPSQWDAFLVQIEQLINERIAEFARNAAIANLEGLGNNFNIYVEAFKEWEEDPNNPETRTRVIDRFRILDGLLERDIPSFRISGFEVPLLSVYAQAANLHLAILRDSVIFGERWGLTTINVNENYNRLIRHIDEYADHCANTYNRGLNNLPKSTYQDWITYNRLRRDLTLTVLDIAAFFPNYDNRRYPIQPVGQLTREVYTDPLINFNPQLQSVAQLPTFNVMESSRIRNPHLFDILNNLTIFTDWFSVGRNFYWGGHRVISSLIGGGNITSPIYGREANQEPPRSFTFNGPVFRTLSNPTLRLLQQPWPAPPFNLRGVEGVEFSTPTNSFTYRGRGTVDSLTELPPEDNSVPPREGYSHRLCHATFVQRSGTPFLTTGVVFSWTDRSATLTNTIDPERINQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQKAVNALFTSSNQIGLKTDVTDYHIDQVSNLVDCLSDEFCLDEKRELSEKVKHAKRLSDERNLLQDPNFRGINRQPDRGWRGSTDITIQGGDDVFKENYVTLPGTVDECYPTYLYQKIDESKLKAYTRYELRGYIEDSQDLEIYLIRYNAKHEIVNVPGTGSLWPLSAQSPIGKCGEPNRCAPHLEWNPDLDCSCRDGEKCAHHSHHFTLDIDVGCTDLNEDLGVWVIFKIKTQDGHARLGNLEFLEEKPLLGEALARVKRAEKKWRDKREKLQLETNIVYKEAKESVDALFVNSQYDRLQVDTNIAMIHAADKRVHRIREAYLPELSVIPGVNAAIFEELEGRIFTAYSLYDARNVIKNGDFNNGLLCWNVKGHVDVEEQNNHRSVLVIPEWEAEVSQEVRVCPGRGYILRVTAYKEGYGEGCVTIHEIEDNTDELKFSNCVEEEVYPNNTVTCNNYTGTQEEYEGTYTSRNQGYDEAYGNNPSVPADYASVYEEKSYTDGRRENPCESNRGYGDYTPLPAGYVTKDLEYFPETDKVWIEIGETEGTFIVDSVELLLMEE

SEQ ID NO: 154 - protein, 181 aa, Bacillus thuringiensis E05-20a
LTVLDIAAFFPNYDNRRYPIQPVGQLTREVYTDPLINFNPQLQSVAQLPTFNVMESSAIRNPHLFDILNNLTIFTDWFSVGRNFYWGGHRVISSLIGGGNITSPIYGREANQEPPRSFTFNGPVFRTLSNPTLRLLQQPWPAPPFNLRGVEGVEFSTPTNSFTYRGRGTVDSLTELPPEDN

SEQ ID NO: 155 - protein, 1044 aa, Bacillus thuringiensis C-33
MEENNQNQCIPYNCLSNPEEVLLDGERISTGNSSIDISLSLVQFLVSNFVPGGGFLVGLIDFVWGIVGPSQWDAFLVQIEQLINERIAEFARNAAIANLEGLGNNFNIYVEAFKEWEEDPNNPATRTRVIDRFRILDGLLERDIPSFRISGFEVPLLSVYAQAANLHLAILRDSVIFGERWGLTTINVNENYNRLIRHIDEYADHCANTYNRGLNNLPKSTYQDWITYNRLRRDLTLTVLDIAAFFPNYDNRRYPIQPVGQLTREVYTDPLINFNPQLQSVAQLPTFNVMESSAIRNPHLFDILNNLTIFTDWFSVGRNFYWGGHRVISSLIGGGNITSPIYGREANQEPPRSFTFNGPVFRTLSNPTLRLLQQPWPAPPFNLRGVEGVEFSTPTNSFTYRGRGTVDSLTELPPEDNSVPPREGYSHRLCHATFVQRSGTPFLTTGVVFSWTHRSATLTNTIDPERINQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQKAVNALFTSSNQIGLKTDVTDYHIDQVSNLVDCLSDEFCLDEKRELSEKVKHAQRLSDERNLLQDPNFRGINRQPDRGWRGSTDITIQGGDDVFKENYVTLPGTVDECYPTYLYQKIDESKLKAYTRYELRGYIEDSQDLEIYLIRYNAKHEIVNVPGTGSLWPLSAQSPIGKCGEPNRCAPHLEWNPDLDCSCRDGEKCAHHSHHFTLDIDVGCTDLNEDLGVWVIFKIKTQDGHARLGNLEFLEEKPLLGEALARVKRAEKKWRDKREKLQLETNIVYKEAKESVDALFVNSQYDRLQVDTNIAMIHAADKRVHRIREAYLPELSVIPGVNAAIFEELEGRIFTAYSLYDARNVIKNGDFNNGLLCWNVKGHVDVEEQNNHRSVLVIPEWEAEVSQEVRVCPGRGYILRVTAY

SEQ ID NO: 156 - protein, 1191 aa, Bacillus thuringiensis LB-R-78
MENNIQNQCIPYNCLSNPEEVLLDGERISTGNSSIDISLSLVQFLVSNFVPGGGFLVGLIDFVWGIVGPSQWDAFLVQIEQLINERIAEFARNAAIANLEGLGNNFNIYVEAFKEWEEDPNNPATRTRVIDRFRILDGLLERDIPSFRISGFEVPLLSVYAQAANLHLAILRDSVIFGERWGLTTINVNENYNRLIRHIDEYADHCANTYNRGLNNLPKSTYQDWITYNRLRRDLTLTVLDIAAFFPNYDNRRYPIQPVGQLTREVYTDPLINFNPQLQSVAQLPTFNVMESSAIRNPHLFDILNNLTIFTDWFSVGRNFYWGGHRVISSLIGGGNITSPIYGREANQEPPRSFTFNGPVFRTLSNPTLRLLQQPWPAPPFNLRGVEGVEFSTPTNSFTYRGRGTVDSLTELPPEDNSVPPREGYSHRLCHATFVQRSGTPFLTTGVVFSWTHRSATLTNTIDPERINQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQKVDAVNALFTSSNQIGLKTDVTDYHIDQVSNLVDCLSDEFCLDEKRELSEKVKHAKRLSDERNLLQDPNFRGINRQPDRGWRGSTDITIQGGDDVFKENYVTLPGTVDECYPTYLYQKIDESKLKAYTRYELRGYIEDSQDLEIYLIRYNAKHEIVNVPGTGSLWPLSAQSPIGKCGEPNRCAPHLEWNPDLDCSCRDGEKCAHHSHHFTLDIDVGCTDLNEDLGVWVIFKIKTQDGHARLGNLEFLEEKPLLGGALARVKRAEKKWRDKREKLQLETNIVYKEAKESVDALFVNSQYDRLQVDTNIAMIHAADKRVHRIREAYLPELSVIPGVNAAIFEELEGRIFTAYSLYDARNVIKNGDFNNGLLCWNVKGHVDVEEQNNHRSVLVIPEWEAEVSQEVRVCPGRGYILRVTAYKEGYGEGCVTIHEIEDNTDELKFSNCVEEEVYPNNTVTCNNYTGTQEEYEGTYTSRNQGYDEAYGNNPSVPADYASVYEEKSYTDGRRENPCESNRGYGDYTPLPAGYVTKDLEYFPETDKVWIEIGETEGTFIVDSVELLLMEE

SEQ ID NO: 157 - protein, 823 aa, Bacillus thuringiensis aizawai 7.29
MEENNQNQCIPYNCLSNPEEVLLDGERISTGNSSIDISLSLVQFLVSNFVPGGGFLVGLIDFVWGIVGPSQWDAFLVQIEQLINERIAEFARNAAIANLEGLGNNFNIYVEAFKEWEEDPNNPATRTRVIDRFRILDGLLERDIPSFRISGFEVPLLSVYAQAANLHLAILRDSVIFGERWGLTTINVNENYNRLIRHIDEYADHCANTYNRGLNNLPKSTYQDWITYNRLRRDLTLTVLDIAAFFPNYDNRRYPIQPVGQLTREVYTDPLINFNPQLQSVAQLPTFNVMESSAIRNPHLFDILNNLTIFTDWFSVGRNFYWGGHRVISSLIGGGNITSPIYGREANQEPPRSFTFNGPVFRTLSIPTLRLLQQPCQRHHFNLRGGEGVEFSTPTNSFTYRGRGTVDSLTELPPEDNSVPPREGYSHRLCHATFVQRSGTPFLTTGVVFSWTHRSATLTNTIDPERINQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQKAVNALFTSSNQIGLKTDVTDYHIDQVSNLVDCLSDEFCLDEKRELSEKVKHAKRLSDERNLLQDPNFRGINRQPDRGWRGSTDITIQGGDDVFKENYVTLPGTVDECYPTYLYQKIDESKLKAYTRYELRGYIEDSQDLEIYLIAYNAKHEIVNVPGTGSLWPLSAQSPIGKCGEPNRCAPHLEWNPDLDCSC

SEQ ID NO: 158 - protein, 1189 aa, Bacillus thuringiensis aizawai PS81I
MEENNQNQCIPYNCLSNPEEVLLDGERISTGNSSIDISLSLVQFLVSNFVPGGGFLVGLIDFVWGIVGPSQWDAFLVQIEQLINERIAEFARNAAIANLEGLGNNFNIYVEAFKEWEEDPNNPATRTRVIDRFRILDGLLERDIPSFRISGFEVPLLSVYAQAANLHLAILRDSVIFGERWGLTTINVNENYNRLIRHIDEYADHCANTYNRGLNNLPKSTYQDWITYNRLRRDLTLTVLDIAAFFPNYDNRRYPIQPVGQLTREVYTDPLINFNPQLQSVAQLPTFNVMESSAIRNPHLFDILNNLTIFTDWFSVGRNFYWGGHRVISSLIGGGNITSPIYGREANQEPPRSFTFNGPVFRTLSNPTLRLLQQPWPAPPFNLRGVEGVEFSTPTNSFTYRGRGQVDSLTELPPEDNSVPPREGYSHRLCHATFVQRSGTPFLTTGVVFSWTHRSATLTNTIDPERINQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQKAVNALFTSSNQIGLKTDVTDYHIDQVSNLVDCLSDEFCLDEKRELSEKVKHAKRLSDERNLLQDPNFRGINRQPDRGWRGSTDITIQGGDDVFKENYVTLPGTVDECYPTYLYQKIDESKLKAYTRYELRGYIEDSQDLEIYLIRYNAKHEIVNVPGTGSLWPLSAQSPIGKCGEPNRCAPHLEWNPDLDCSCRDGEKCAHHSHHFTLDIDVGCTDLNEDLGLWVIFKIKTQDNHARLGNLEFLEEKPLLGEALARVKRAEKKWRDKREKLQLETNIVYKEAKESVDALFVNSQYDRLQVNTNIAMIHAADKRVHRIREAYLPELSVIPGVNAAIFEELEGRIFTAYSLYDARNVIKNGDFNNGLLCWNVKGHVDVEEQNNHRSVLVIPEWEAEVSQEVRVCPGRGYILRVTAYKEGYGEGCVTIHEIEDNTDELKFSNCVEEEVYPNNTVTCNNYTGTQEEYEGTYTSRNQGYDEAYGNNPSVPADYASVYEEKSYTDGRRENPCESNRGYGDYTPLPAGYVTKDLEYFPETDKVWIEIGETEGTFIVDSVELLLMEE

SEQ ID NO: 159 - protein, 1189 aa, Bacillus thuringiensis entomocidus HD110
MEENNQNQCIPYNCLSNPEEVLLDGERISTGNSSIDISLSLVQFLVSNFVPGGGFLVGLIDFVWGIVGPSQWDAFLVQIEQLINERIAEFARNAAIANLEGLGNNFNIYVEAFKEWEEDPNNPETRTRVIDRFRILDGLLERDIPSFRISGFEVPLLSVYAQAANLHLAILRDSVIFGERWGLTTINVNENYNRLIRHIDEYADHCANTYNRGLNNLPKSTYQDWITYNRLRRDLTLTVLDIAAFFPNYDNRRYPIQPVGQLTREVYTDPLINFNPQLQSVAQLPTFNVMESSAIRNPHLFDILNNLTIFTDWFSVGRNFYWGGHRVISSLIGGGNITSPIYGREANQEPPRSFTFNGPVFRTLSNPTLRLLQQPWPAPPFNLRGVEGVEFSTPTNSFTYRGRGTVDSLTELPPEDNSVPPREGYSHRLCHATFVQRSGTPFLTTGVVFSWTHRSATLTNTIDPERINQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQKAVNALFTSSNQIGLKTDVTDYHIDQVSNLVDCLSDEFCLDEKRELSEKVKHAKRLSDERNLLQDPNFRGINRQPDRGWRGSTDITIQGGDDVFKENYVTLPGTVDECYPTYLYQKIDESKLKAYTRYELRGYIEDSQDLEIYLIRYNAKHEIVNVPGTGSLWPLSAQSPIGKCGEPNRCAPHLEWNPDLDCSCRDGEKCAHHSHHFTLDIDVGCTDLNEDLGVWVIFKIKTQDGHARLGNLEFLEEKPLLGEALARVKRAEKKWRDKREKLQLETNIVYKEAKESVDALFVNSQYDRLQVDTNIAMIHAADKRVHRIREAYLPELSVIPGVNAAIFEELEGRIFTAYSLYDARNVIKNGDFNNGLLCWNVKGHVDVEEQNNHRSVLVIPEWEAEVSQEVRVCPGRGYILRVTAYKEGYGEGCVTIHEIEDNTDELKFSNCVEEEVYPNNTVTCNNYTGTQEEYEGTYTSRNQGYDEAYGNNPSVPADYASVYEEKSYTDGRRENPCESNRGYGDYTPLPAGYVTKDLEYFPETDKVWIEIGETEGTFIVDSVELLLMEE

SEQ ID NO: 160 - protein, 756 aa, Bacillus thuringiensis aizawai 7.29
MEENNQNQCIPYNCLSNPEEVLLDGERISTGNSSIDISLSLVQFLVSNFVPGGGFLVGLIDFVWGIVGPSQWDAFLVQIEQLINERIAEFARNAAIANLEGLGNNFNIYVEAFKEWEEDPNNPATRTRVIDRFRILDGLLERDIPSFRISGFEVPLLSVYAQAANLHLAILRDSVIFGERWGLTTINVNENYNRLIRHIDEYADHCANTYNRGLNNLPKSTYQDWITYNRLRRDLTLTVLDIAAFFPNYDNRRYPIQPVGQLTREVYTDPLINFNPQLQSVAQLPTFNVMESSAIRNPHLFDILNNLTIFTDWFSVGRNFYWGGHRVISSLIGGGNITSPIYGREANQEPPRSFTFNGPVFRTLSNPTLRLLQQPWPAPPFNLRGVEGVEFSTPTNSFTYRGRGTVDSLTELPPEDNSVPPREGYSHRLCHATFVQRSGTPFLTTGVVFSWTHRSATLTNTIDPERINQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQKAVNALFTSSNQIGLKTDVTDYHIDQVSNLVDCLSDEFCLDEKRELSEKVKHAKRLSDERNLLQDPNFRGINRQPDRGWRGSTDITIQGGDDVFKENYVTLPGTVDECYPTYLYQKIDESKLKAYTR

SEQ ID NO: 161 - protein, 1189 aa, Bacillus thuringiensis AF-2
MEENNQNQCIPYNCLSNPEEVLLDGERISTGNSSIDISLSLVQFLVSNFVPGGGFLVGLIDFVWGIVGPSQWDAFLVQIEQLINERIAEFARNAAIANLEGLGNNFNIYVEAFKEWEEDPNNPATRTRVIDRFRILDGLLERDIPSFRISGFEVPLLSVYAQAANLHLAILRDSVIFGERWGVTTINVNENYNRLIRHIDEYADHCANTYNRGLNNLPKSTYQDWITYNRLRRDLTLTVLDIAAFFPNYDNRRYPIQPVGQLTREVYTDPLINFNPQLQSVAQLPTFNVMESSAIRNPHLFDILNNLTIFTDWFSVGRNFYWGGHRVISSLIGGGNITSPIYGREANQEPPRSFTFNGPVFRTLSNPTLRLLQQPWPAPPFNLRGVEGVEFSTPTNSFTYRGRGTVDSLTELPPEDNSVPPREGYSHRLCHATFVQRSGTPFLTTGVVFSWTHRSATLTNTIDPERINQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISERPLFGAGSISSGELYIDKIEIILADATFEAESDLERAQKAVNALFTSSNQIGLKTDVTDYHIDQVSNLVDCLSDEFCLDEKRELSEKVKHAKRLSDERNLLQDPNFRGINRQPDRGWRGSTDITIQGGDDVFKENYVTLPGTVDECYPTYLYQKIDESKLKAYTRYELRGYIEDSQDLEIYLIRYNAKHEIVNVPGTGSLWPLSAQSPIGKCGEPNRCAPHLEWNPDLDCSCRDGEKCAHHSHHFTLDIDVGCTDLNEDLGVWVIFKIKTQDGHARLGNLEFLEEKPLLGEALARVKRAEKKWRDKREKLQLETNIVYKEAKESVDALFVNSQYDRLQVDTNIAMIHAADKRVHRIREAYLPELSVIPGVNAAIFEELEGRIFTAYSLYDARNVIKNGDFNNGLLCWNVKGHVDVEEQNNHRSVLVIPEWEAEVSQEVRVCPGRGYILRVTAYKEGYGEGCVTIHEIEDNTDELKFSNCVEEEVYPNNTVTCNNYTGTQEEYEGTYSSRNQGYDEAFGNNPSVPADYASVYEEKSYTDGRRENPCESNRGYGDYTPLPAGYVTKDLEYFPETDKVWIEIGETEGTFIVDSVELVLMEE

SEQ ID NO: 162 - protein, 1189 aa, Bacillus thuringiensis J8
MEENNQNQCIPYNCLSNPEEVLLDGERISTGNSSIDISLSLVQFLVSNFVPGGGFLVGLIDFVWGIVGPSQWDAFLVQIEQLINERIAEFARNAAIANLEGLGNNFNIYVEAFKEWEEDPNNPATRTRVIDRFRILDGLLERDIPSFRISGFEVPLLSVYAQAANLHLAILRDSVIFGERWGLTTINVNENYNRLIRHIDEYADHCANTYNRGLNNLPKSTYQDWITYNRLRRDLTLTVLDIAAFFPNYDNRRYPIQPVGQLTREVYTDPLINFNPQLQSVAQLPTFNVMESSAIRNPHLFDILNNLTIFTDWFSVGRNFYWGGHRVISSLIGGGNITSPIYGREANQEPPRSFTFNGPVFRTLSNPTLRLLQQPWPAPPFNLRGVEGVEFSTPTNSFTYRGRGTVDSLTELPPEDNSVPPREGYSHRLCHATFVQRSGTPFLTTGVVFSWTHRSATLTNTIDPERINQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQKAVNALFTSSNQIGLKTDVTDYHIDQVSNLVDCLSDEFCLDEKRELSEKVKHAKRLSDERNLLQDPNFRGINRQPDRGWRGSTDITIQGGDDVFKENYVTLPGTVDECYPTYLYQKIDESKLKAYTRYELRGYIEDSQDLEIYLIRYNAKHEIVNVPGTGSLWPLSAQSPIGKCGEPNRCAPHLEWNPDLDCSCRDGEKCAHHSHHFTLDIDVGCTDLNEDLGVWVIFKIKTQDGHARLGNLEFLEEKPLLGEALARVKRAEKKWRDKREKLQLETNIVYKEAKESVDALFVNSQYDRLQVDTNIAMIHAADKRVHRIREAYLPELSVIPGVNAAIFEELEGRIFTAYSLYDARNVIKNGDFNNGLLCWNVKGHVDVEEQNNHRSVLVIPEWEAEVSQEVRVCPGRGYILRVTAYKEGYGEGCVTIHEIEDNTDELKFSNCVEEEVYPNNTVTCNNYTGTQEEYEGTYTSRNQGYDEAYGNNPSVPADYASVYEEKSYTDGRRENPCESNRGYGDYTPLPAGYVTKDLEYFPETDKVWIEIGETEGTFIVDSVELLLMEE

SEQ ID NO: 163 - protein, 1189 aa, Bacillus thuringiensis c002; identical to SEQ ID NO: 162

SEQ ID NO: 164 - protein, 1189 aa, Bacillus thuringiensis G10-01A; identical to SEQ ID NO: 162

SEQ ID NO: 165 - protein, 1176 aa, Bacillus thuringiensis c001
MENNIQNQCVPYNCLSNPEEILLDGERISTGNSSIDISLSLVQLLVSNFVPGGGFLVGLLDFVWGIVGPSPWDAFLVQIEQLINERIAAYARSAAISNLEGLGNNFNIYVEAFKEWEADPDNPVTRTRVVDRFRILDGLLERDIPSFRIAGFEVPLLSVYAQAANLHLAILRDSSIFGARWGLTTINVNENYNRLIRHIDEYANHCADTYNRGLNNLPKSTYQDWITYNRLRRDLTLTVLDIAAFFPSYDNRRYPIQSVGQLTREIYTDPLITFNPQLQSVAQLPTFNVMESNAIRTPHLFDVLNNLTIFTDWFSVGRNFYWGGHRVISNRIGGGNITSPIYGREANQEPPRSFTFNGPVFRTLSNPTFRPLQQPWPAPPFNLRGVEGVEFSTPLNSFTYRGRGTVDSLTELPPEDNSVPPREGYSHRLCHATFVQRSGTPFLTTGPVFSWTHRSATDRNIIYPDVINQIPLVKAFNLTSGTSVVRGPGFTGGDIIRTNVNGSVLSMSLNFSNTTLQRYRVRVRYAASQTMVMSVTVGGSTTGNQGFPSTMSANGALTSQSFRFAEFPVGISASGSQGASISISNNVGRQMFHLDRIEFLPVTSTFEEEYDLERAQEAVNALFTSTNQLGLKTDVTDYHIDQVSNLVECLSDEFCLDEKRELSEKVKHAKRLSDERNLLQDRNFRSINGQLDRGWRGSTDITIQGGDDVFKENYVTLPGTFDECYPTYLYQKIDESKLKSYTRYELRGYIEDSQDLEIYLIRYNAKHEIVNVPGTGSLWPLSIENSIGPCGEPNRCAPHLEWNPNLDCSCRDGEKCAHHSHHFSLDIDVGCTDLNEDLGVWVIFKIKTQDGHARLGNLEFLEEKPLLGEALARVKRAEKKWRDKREKLEWETNIVYKEAKESVDALFVNSQYDRLQADTNIAMIHAADKRVHRIREAYLPELSVIPGVNAGIFEELEGRIFTAYSLYDARNVIKNGDFNNGLLCWNLKGHVDVEEQNNHRSVLVVPEWEAEVSQEVRVCPGRGYILRVTAYKEGYGEGCVTIHEIEDNTDELKFSNCVEEEVYPNNTVTCNDYTATQEEYGGAYTSRNHGYGKSYESNSSVQADYASVYEEKADTDGRRDNHCESNRGYGDYTPLPAGYVTKELEYFPETDKVWVEIGETEGTFIVDSVELLLMEE

SEQ ID NO: 166 - protein, 646 aa, Bacillus thuringiensis 087
MVMSVTVGGSTTGNQGFPSTMSANGALTSQSFRFAEFPVGISASGSQGASISISNNVGRQMFHLDRIEFLPVTSTFEEEYDLERAQEAVNALFTSTNQLGLKTDVTDYHIDQVSNLVECLSDEFCLDEKRELSEKVKHAKRLSDERNLLQDRNFRSINGQLGRGWRGSTDITIQGGDDVFKENYVTLPGTFDECYPTYLYQKIDESKLKSYTRYELRGYIEDSQDLEIYLIRYNAKHEIVNVPGTGSLWPLSIENSIGPCGEPNRCAPHLEWNPNLDCSCRDGEKCAHHSHHFSLDIDVGCTDLNEDLGVWVIFKIKTQDGHARLGNLEFLEEKPLLGEALARVKRAEKKWRDKREKLEWETNIVYKEAKESVDALFVNSQYDRLQADTNIAMIHAADKRVHRIREAYLPELSVIPGVNAGIFEELEGRIFTAYSLYDARNVIKNGDFNNGLLCWNLKGHVDVEEQNNHRSVLVVPEWEAEVSQEVRVCPGRGYILRVTAYKEGYGEGCVTIHEIEDNTDELKFSNCVEEEVYPNNTVTCNDYTATQEEYGGAYTSRNHGYGKSYESNSSVQADYASVYEEKADTDGRRDNHCESNRGYGDYTPLPAGYVTKELEYFPETDKVWVEIGETEGTFIVDSVELLLMEE

SEQ ID NO: 167 - protein, 244 aa, Bacillus thuringiensis TA476-1
TIQGGDDVFKENYVTLPGTFDECYPTYLYQKIDESKLKAYTRYQLRGYIGDSQDLEIYLIRYNAKHEIVNVPGTGSLWTLSVENSIGPCGEPNRCAPHLEWNPNLECSCREGEKCAHHSHHFSLDIDVGCTDLNEDLGVWAIFKIKTQDGHARLGNLEFLEEKPLVGEALARVKRAEKKWRDKREKLELETNIVYKEAKESVDALFVNSQYDRLQADTNIAMIHAADKRVHSIREAYLPELSII

SEQ ID NO: 168 - protein, 1165 aa, Bacillus thuringiensis aizawai HD68
MEINNQNQCVPYNCLSNPKEIILGEERLETGNTVADISLGLINFLYSNFVPGGGFIVGLLELIWGFIGPSQWDIFLAQIEQLISQRIEEFARNQAISRLEGLSNLYKVYVRAFSDWEKDPTNPALREEMRIQFNDMNSALITAIPLFRVQNYEVALLSVYVQAANLHLSILRDVSVFGERWGYDTATINNRYSDLTSLIHVYTNHCVDTYNQGLRRLEGRFLSDWIVYNRFRRQLTISVLDIVAFFPNYDIRTYPIQTATQLTREVYLDLPFINENLSPAASYPTFSAAESAIIRSPHLVDFLNSFTIYTDSLARYAYWGGHLVNSFRTGTTTNLIRSPLYGREGNTERPVTITASPSVPIFRTLSYITGLDNSNPVAGIEGVEFQNTISRSIYRKSGPIDSFSELPPQDASVSPAIGYSHRLCHATFLERISGPRIAGTVFSWTHRSASPTNEVSPSRITQIPWVKAHTLASGASVIKGPGFTGGDILTRNSMGELGTLRVTFTGRLPQSYYIRFRYASVANRSGTFRYSQPPSYGISFPKTMDAGEPLTSRSFAHTTLFTPITFSRAQEEFDLYIQSGVYIDRIEFIPVTATFEAEYDLERAQKVVNALFTSTNQLGLKTDVTDYHIDQVSNLVACLSDEFCLDEKRELSEKVKHAKRLSDERNLLQDPNFRGINRQPDRGWRGSTDITIQGGDDVFKENYVTLPGTFDECYPTYLYQKIDESKLKAYTRYQLRGYIEDSQDLEIYLIRYNAKHEIVNVPGTGSLWPLSVENQIGPCGEPNRCAPHLEWNPDLHCSCRDGEKCAHHSHHFSLDIDVGCTDLNEDLGVWVIFKIKTQDGHARLGNLEFLEEKPLLGEALARVKRAEKKWRDKRETLQLETTIVYKEAKESVDALFVNSQYDRLQADTNIAMIHAADKRVHRIREAYLPELSVIPGVNAAIFEELEERIFTAFSLYDARNIIKNGDFNNGLLCWNVKGHVEVEEQNNHRSVLVIPEWEAEVSQEVRVCPGRGYILRVTAYKEGYGEGCVTIHEIENNTDELKFNNCVEEEVYPNNTVTCINYTATQEEYEGTYTSRNRGYDEAYGNNPSVPADYASVYEEKSYTDRRRENPCESNRGYGDYTPLPAGYVTKELEYFPETDKVWIEIGETEGTFIVDSVELLLMEE

SEQ ID NO: 169 - protein, 1176 aa, Bacillus thuringiensis; identical to SEQ ID NO: 56

SEQ ID NO: 170 - protein, 1160 aa, Bacillus thuringiensis BTS00349A
MDINHQNQCIPYNCLSNPDAILLDAERLETGNTVADISLGLINFLYSNFVPGGGFIVGLLELIWGFVGPSQWEIFLAQIEQLISQRIEEFARNQAISRLEGLSNNYEIYTETFRAWEKDPSNPALREEMRTQFNVMNSALIAAIPLLRVRNYEVALLSVYVQAANLHLSVLRDVSVYGQRWGFDPATVNSRYSDLTRLIHVYTDHCVDTYNDGLKNLEGSRLSDWVVYNRFRRRLTISVLDIIAFFPNYDIEAYPIQTASQLTREVYLDLPFVNETLSPPASYPTFSAAESAIIRSPHLVDFLNSFTIYTDSLASYAYWGGHLVNSFRTGTTTNLIRSPLYGREGNTERPVTISASPSVPIFRTLSYFTGLNNNNPVAGIEGVEFQNTISRSIYRKSGPIDSFSELPPQDVSVSPAIGYSHRLCHATFLERISGPRIAGTVFSWTHRSASPINEVSPSRITQIPWVKAHTLASGASVIKGPGFTGGDILTRNSMGDLGALRVTFTGRLPQSYYIRFRYASVANRSGTFRYSQPPSYGISFPKTMDAGEALTSRSFAHTTLFTPITFSRAQEEFDLYIQSGVYIDRIEFIPVDATFESEINLERAQKAVNALFTSTNQLGLKTDVTDYHIDQVSNLVECLSDEFCLDEKRELSEKVKHAKRLSDERNLLQDPNFRGINRQPDRGWRGSTDITIQGGDDVFKENYVTLTGTFDECYPTYLYQKIDESKLKAYTRYQLRGYIEDSQDLEIYLIRYNAKHEIVNVPGTGSLWPLSVQSPIGKCGEPNRCAPHLEWNPDLDCSCRDEEKCAHHSHHFSLDIDVGCTDLNEDLGVWVIFKIKTQDGHARLGNLEFLEEKPLVGEALARVKRAEKKWRDKREKLELETNIVYKEAKESVDALFVNSQYDQLQADTNIAMIHAADKRVHSIREAYLPELSVIPGVNAGIFEELEGRIFTAYSLYDARNVIKNGDFNNGLSCWNVKGHVDVEEQNNHRSVLVVPEWEAEVSQEVRVCPGRGYILRVTAYKEGYGEGCVTIHEVDNNTDELKFSNCEKEQVYPGNTVACNDYNKNHGANACSSRNRGYDESYESNSSIPADYAPVYEEEAYTDGQRGNPCEFNRGHTPLPAGYVTAELEYFPETDTVWVEIGETEGTFIVDSVELLLMEE

SEQ ID NO: 171 - protein, 1160 aa, Bacillus thuringiensis B-Pr-88
MDINHQNQCIPYNCLSNPDAILLDAERLETGNTVADISLGLINFLYSNFVPGGGFIVGLLELIWGFVGPSQWEIFLAQIEQLISQRIEEFARNQAISRLEGLSNNYEIYTETFRAWEKDPSNPALREEMRTQFNVMNSALIAAIPLLRVRNYEVALLSVYVQAANLHLSVLRDVSVYGQRWGFDPATVNSRYSDLTRLIHVYTDHCVDTYNDGLKNLEGSRLSDWVVYNRFRRRLTISVLDIIAFFPNYDIEAYPIQTASQLTREVYLDLPFVNETLSPPASYPTFSAAESAIIRSPHLVDFLNSFTIYTDSLASYAYWGGHLVNSFRTGTTTNLIRSPLYGREGNTERPVTISASPSVPIFRTLSYFTGLNNNNPVAGIEGVEFQNTISRSIYRKSGPIDSFSELPPQDVSVSPAIGYSHRLCHATFLERISGPRIAGTVFSWTHRSASPINEVSPSRITQIPWVKAHTLASGASVIKGPGFTGGDILTRNSMGDLGALRVTFTGRLPQSYYIRFRYASVANRSGTFRYSQPPSYGISFPKTMDAGEALTSRSFAHTTLFTPITFSRAQEEFDLYIQSGVYIDRIEFIPVDATFESEINLERAQKAVNALFTSTNQLGLKTDVTDYHIDQVSNLVECLSDEFCLDEKRELSEKVKHAKRLSDERNLLQDPNFRGINRQPDRGWRGSTDITIQGGDDVFKENYVTLTGTFDECYPTYLYQKIDESKLKAYTRYQLRGYIEDSQDLEIYLIRYNAKHEIVNVPGTGSLWPLSVQSPIGKCGEPNRCAPHLEWNPDLDCSCRDEEKCAHHSHHFSLDIDVGCTDLNEDLGVWVIFKIKTQDGHARLGNLEFLEEKPLVGEALARVKRAEKKWRDKREKLELETNIVYKEAKESVDALFVNSQYDQLQADTNIAMIHAADKRVHSIREAYLPELSVIPGVNAGIFEELEGRIFTAYSLYDARNVIKNGDFNNGLSCWNVKGHVDVEEQNNHRSVLVVPEWEAEVSQEVRVCPGRGYILRVTAYKEGYGEGCVTIHEVDNNTDELKFSNCEKEQVYPGNTVACNDYNKNHGANACSSRNRGYDESYESNSSIPADYAPVYEEEAYTDGQRGNPSEFNRGHTPLPAGYVTAELEYFPETDTVWVEIGETEGTFIVDSVELLLMEE

SEQ ID NO: 172 - protein, 1173 aa, Bacillus thuringiensis JC291
MEIINNQNQCVPYNCLSNPENEILDIESLSSRSREQVAEISLGLTRFLLESLLPGASFGFALFDIIWGVIGPDQWNLFLAQIEQLIDQRIEAHVRNQAISRLEGLGDSYEVYIESLREWEGSPNNEGLQQDVRNRFSNTDNALITGYLFLREQGFEIPLLSVYVQAANLHLSILRDVSVFGERWGYDTATINNRYSDLTSLIHVYTNHCVDTYNQGLRRLEGRFLTDWIVYNRFRRQFTISVLDIVAFFPNYDIRTYPIHTATQLTREIYLDLPFINENLSPAASYPTFSAAESAIIRSPHLVDFLNSFTIYTDSLARYAYWGGHLVNCFRTGTTTNLIRSPLYGREGNTERPVTITASPSVPIFRTLSYITGLDNSNPVAGIEGVEFQNTISRSIYRKSGPIDSFNELPPQDASVSPSIGYSHRLCHATFLERISGPRIAGVVFPWTHRSASPTNEVSSSRKTQIPWVKAHTLASGASVIKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLPGTFDECYPTYLYQKIDESKLKAYTRYQLRGYIEDSQDLEIYLIRYNAKHEIVNVPGTGSLWPLSVENQIGPCGEPNRCAPHLEWNPDLHCSCRDGENVPIIPIISPWDIDVGCTDLNEDLGVWVIFKIKTQDGHARLGNLEFLEEKPLVGEALARVKRAEKKWRDKREKLELETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFNNCVEEEVYPNNTVTCINYTATQEEYEGTYTSRNRGYDEAYGNNPSVPADYASVYEEKSYTDRRRENPCESNRGYGDYTPLPAGYVTKELEYFPETDKVWIEIGETEGTFIVDSVELLLMEE

SEQ ID NO: 173 - protein, 1171 aa, Bacillus thuringiensis kenyae 4F1
MEIVNNQNQCVPYNCLNNPENEILDIERSNSTVATNIALEISRLLASATPIGGILLGLFDAIWGSIGPSQWDLFLEQIELLIDQKIEEFARNQAISRLEGISSLYGIYTEAFREWEADPTNPALKEEMRTQFNDMNSILVTAIPLFSVQNYQVPFLSVYVQAANLHLSVLRDVSVFGQAWGFDIATINSRYNDLTRLIPIYTDYAVRWYNTGLDRLPRTGGLRNWARFNQFRRELTISVLDIISFFRNYDSRLYPIPTSSQLTREVYTDPVINITDYRVGPSFENIENSAIRSPHLMDFLNNLTIDTDLIRGVHYWAGHRVTSHFTGSSQVITTPQYGITANAEPRRTIAPSTFPGLNLFYRTLSNPFFRRSENITPTLGINVVQGVGFIQPNNAEVLYRSRGTVDSLNELPIDGENSLVGYSHRLSHVTLTRSLYNTNITSLPTFVWTHHSATNTNTINPDIITQIPLVKGFRLGGGTSVIKGPGFTGGDILRRNTIGEFVSLQVNINSPITQRYRLRFRYASSRDARITVAIGGQIRVDMTLEKTMEIGESLTSRTFSYTNFSNPFSFRANPDIIRIAEELPIRGGELYIDKIELILADATFEEEYDLERAQKAVNALFTSTNQLGLKTDVTDYHIDQVSNLVECLSDEFCLDEKRELSEKVKHAKRLSDERNLLQDPNFRGINRQPDRGWRGSTDITIQGGDDVFKENYVTLPGTFDECYPTYLYQKIDESKLKAYTRYELRGYIEDSQDLEIYLIRYNAKHETVNVPGTGSLWPLSAQSPIGKCGEPNRCAPHLEWNPNLDCSCRDGEKCAHHSHHFSLDIDVGCTDLNEDLGVWVIFKIKTQDGYARLGNLEFLEENPLLGEALARVKRAEKKWRDKCEKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIEDNTDELKFSNCVEEEVYPNNTVTCNNYTATQEEHEGTYTSRNRGYDEAYESNSSVHASVYEEKSYTDRRRENPCESNRGYGDYTPLPAGYVTKELEYFPETDKVWIEIGETEGTFIVDSVELLLMEE

SEQ ID NO: 174 - protein, 1171 aa, Bacillus thuringiensis BR64
MEIVNNQNQCVPYNCLNNPENEILDIERSNSTVATNIALEISRLLASATPIGGILLGLFDAIWGSIGPSQWDLFLEQIELLIDQKIEEFARNQAISRLEGISSLYGIYTEAFREWEADPTNPALKEEMRTQFNDMNSILVTAIPLFSVQNYQVPFLSVYVQAANLHLSVLRDVSVFGQAWGFDIATINSRYNDLTRLIPIYTDYAVRWYNTGLDRLPRTGGLRNWARFNQFRRELTISVLDIISFFRNYDSRLYPIPTSSQLTREVYTDPVINITDYRVGPSFENIENSAIRSPHLMDFLNNLTIDTDLIRGVHYWAGHRVTSHFTGSSQVITTPQYGITANAEPRRTIAPSTFPGLNLFYRTLSNPFFRRSENITPTLGINVVQGVGFIQPNNAEVLYRSRGTVDSLNELPIDGENSLVGYSHRLSHVTLTRSLYNTNITSLPTFVWTHHSATNTNTINPDIITQIPLVKGFRLGGGTSVIKGPGFTGGDILRRNTIGEFVSLQVNINSPITQRYRLRFRYASSRDARITVAIGGQIRVDMTLEKTMEIGESLTSRTFSYTNFSNPFSFRANPDIIRIAEELPIRGGELYIDKIELILADATFEEEYDLERAQKAVNALFTSTNQLGLKTDVTDYHIDQVSNLVECLSDEFCLDEKRELSEKVKHAKRLSDERNLLQDPNFRGINRQPDRGWRGSTDITIQGGDDVFKENYVTLPGTFDECYPTYLYQKIDESKLKAYTRYELRGYIEDSQDLEIYLIRYNAKHETVNVPGTGSLWPLSAQSPIGKCGEPNRCAPHLEWNPNLDCSCRDGEKCAHHSHHFSLDIDVGCTDLNEDLGVWVIFKIKTQDGYARLGNLEFLEEKPLLGEALARVKRAEKKWRDKCEKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVAIHEIEDNTDELKFSNCVEEEVYPNNTVTCNNYTATQEEHEGTYTSRNRGYDEAYESNSSVHASVYEEKSYTDRRRENPCESNRGYGDYTPLPAGYVTKELEYLPETDKVWIEIGETEGTFIVDSVELLLMEE

SEQ ID NO: 175 - protein, 1171 aa, Bacillus thuringiensis kenyae; identical to SEQ ID NO: 173

SEQ ID NO: 176 - protein, 1171 aa, Bacillus thuringiensis kenyae PS81F
MEIVNNQNQCVPYNCLNNPENEILDIERSNSTVATNIALEISRLLASATPIGGILLGLFDAIWGSIGPSQWDLFLEQIELLIDQKIEEFARNQAISRLEGISSLYGIYTEAFREWEADPTNPALKEEMRTQFNDMNSILVTAIPLFSVQNYQVPFLSVYVQAANLHLSVLRDVSVFGQAWGFDIATINSRYNDLTRLIPIYTDYAVRWYNTGLDRLPRTGGLRNWARFNQFRRELTISVLDIISFFRNYDSRLYPIPTSSQLTREVYTDPVINITDYRVGPSFENIENSAIRSPHLMDFLNNLTIDTDLIRGVHYWAGHRVTSHFTGSSQVITTPQYGITANAEPRRTIAPSTFPGLNLFYRTLSNPFFRRSENITPTLGINVVQGVGFIQPNNAEVLYRSRGTVDSLNELPIDGENSLVGYSHRLSHVTLTRSLYNTNITSLPTFVWTHHSATNTNTINPDIITQIPLVKGFRLGGGTSVIKGPGFTGGDILRRNTIGEFVSLQVNINSPITQRYRLRFRYASSRDARITVAIGGQIRVDMTLEKTMEIGESLTSRTFSYTNFSNPFSFRANPDIIRIAEELPIRGGELYIDKIELILADATFEEEYDLERAQKAVNALFTSTNQLGLKTDVTDYHIDQVSNLVECLSDEFCLDEKRELSEKVKHAKRLSDERNLLQDPNFRGINRQPDRGWRGSTDITIQGGDDVFKENYVTLPGTFDECYPTYLYQKIDESKLKAYTRYELRGYIEDSQDLEIYLIRYNAKHETVNVPGTGSLWPLSAQSPIGKCGEPNRCAPHLEWNPNLDCSCRDGEKCAHHSHHFSLDIDVGCTDLNEDLGVWVIFKIKTQDGYARLGNLEFLEEKPLLGEALARVKRAEKKWRDKCEKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIEDNTDELKFSNCVEEEVYPNNTVTCNNYTATQEEHEGTYTSRNRGYDEAYESNSSVHASVYEEKSYTDRRRENPCESNRGYGDYTPLPAGYVTKELEYFPETDKVWIEIGETEGTFIVDSVELLLMEE

SEQ ID NO: 177 - protein, 1171 aa, Bacillus thuringiensis kenyae LBIT-147
MEIVNNQNQCVPYNCLNNPENEILDIERSNSTVATNIALEISRLLASATPIGGILLGLFDAIWGSIGPSQWDLFLEQIELLIDQKIEEFARNQAISRLEGISSLYGIYTEAFREWEADPTNPALKEEMRTQFNDMNSILVTAIPLFSVQNYQVPFLSVYVQAANLHLSVLRDVSVFGQAWGFDIATINSRYNDLTRLIPIYTDYAVRWYNTGLDRLPRTGGLRNWARFNQFRRELTISVLDIISFFRNYDSRLYPIPTSSQLTREVYTDPVINITDYRVGPSFENIENSAIRSPHLMDFLNNLTIDTDLIRGVHYWAGHRVTSHFTGSSQVITTPQYGNSQNAEPRRTIAPSTFPGLNLFYRTLSNPFFRRSENITPTLGINVVQGVGFIQPNNAEVLYRSRGTVDSLNELPIDGENSLVGYSHRLSHVTLTRSLYNTNITSLPTFVWTHHSATNTNTINPDIITQIPLVKGFRLGGGTSVIKGPGFTGGDILRRNTIGEFVSLQVNINSPITQRYRLRFRYASSRDARITVAIGGQIRVDMTLEKTMEIGESLTSRTFSYTNFSNPFSFRANPDIIRIAEELPIRGGELYIDKIELILADATFEEEYDLERAQKAVNALFTSTNQLGLKTDVTDYHIDQVSNLVECLSDEFCLDEKRELSEKVKHAKRLSDERNLLQDPNFRGINRQPDRGWRGSTDITIQGGDDVFKENYVTLPGTFDECYPTYLYQKIDESKLKAYTRYELRGYIEDSQDLEIYLIRYNAKHETVNVPGTGSLWPLSAQSPIGKCGEPNRCAPHLEWNPNLDCSCRDGEKCAHHSHHFSLDIDVGCTDLNEDLGVWVIFKIKTQDGYARLGNLEFLEEKPLLGEALARVKRAEKKWRDKCEKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIEDNTDELKFSNCVEEEVYPNNTVTCNNYTATQEEHEGTYTSRNRGYDEAYESNSSVHASVYEEKSYTDRRRENPCESNRGYGDYTPLPAGYVTKELEYFPETDKVWIEIGETEGTFIVDSVELLLMEE

SEQ ID NO: 178 - protein, 1171 aa, Bacillus thuringiensis YBT-032; identical to SEQ ID NO: 176

SEQ ID NO: 179 - protein, 1171 aa, Bacillus thuringiensis JC190; identical to SEQ ID NO: 176

SEQ ID NO: 180 - protein, 1171 aa, Bacillus thuringiensis HZM2
MEIVNNQNQCVPYNCLNNPENEILDIERSNSTVATNIALEISRPLASATPIGGILLGLFDAIWGSIGPSQWDLFLEQIELLIDQKIEEFARNQAISRLEGISSLYGIYTEAFREWEADPTNPALKEEMRTQFNDMNSILVTAIPLFSVQNYQVPFLSVYVQAANLHLSVLRDVSVFGQAWGFDIATINSRYNDLTRLIPIYTDYAVRWYNTGLDRLPRTGGLRNWARFNQFRRELTISVLDIISFFRNYDSRLYPIPTSSQLTREVYTDPVINITDYRVGPSFENIENSAIRSPHLMDFLNNLTIDTDLIRGVHYWAGHRVTSHFTGSSQVITTPQYGITANAEPRRTIAPSTFPGLNLFYRTLSNPFFRRSENITPTLGINVVQGVGFIQPNNAEVLYRSRGTVDSLNELPIDGENSLVGYSHRLSHVTLTRSLYNTNITSLPTFVWTHHSATNTNTINPDIITQIPLVKGFRLGGGTSVIKGPGFTGGDILRRNTIGEFVSLQVNINSPITQRYRLRFRYASSRDARITVAIGGQIRVDMTLEKTMEIGESLTSRTFSYTNFSNPFSFRANPDIIRIAEELPIRGGELYIDKIELILADATFEEEYDLERAQKAVNALFTSTNQLGLKTDVTDYHIDQVSNLVECLSDEFCLDEKRELSEKVKHAKRLSDERNLLQDPNFRGINRQPDRGWRGSTDITIQGGDDVFKENYVTLPGTFDECYPTYLYQKIDESKLKAYTRYELRGYIEDSQDLEIYLIRYNAKHETVNVPGTGSLWPLSAQSPIGKCGEPNRCAPHLEWNPNLDCSCRDGEKCAHHSHHFSLDIDVGCTDLNEDLGVWVIFKIKTQDGYARLGNLEFLEEKPLLGEALARVKRAEKKWRDKCEKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRGCPGRGYILRVTAYKEGYGEGCVTIHEIEDNTDELKFSNCVEEEVYPNNTVTCNNYTATQEEHEGTYTSRNRGYDEAYESNSSVHASVYEEKSYTDRRRENPCESNRGYGDYTPLPAGYVTKESEYFPETDKVWIEIGETEGTFIVDSVELLLMEE

SEQ ID NO: 181 - protein, 1174 aa, Bacillus thuringiensis aizawai PS81A2
MENNIENQCIPYNCLNNPEVEILGIERSNSNVAAEIGLGLSRLLVSRIPLGDFILGLFDVIWGAIGPSQWDIFLEQIELLIGQRIEEFARNQAISRLQGLSNLYRIYTNAFKNWEVDPTNPALREEMRIQFNDMNSALTTAIPLFSVQGYEIPLLSVYVQAANLHLSVLRDVSVFGQRWGFDVATINSRYNDLTRLIGEYTDYAVRWYNTGLNRLPRNEGVRGWARFNRFRRELTISVLDIISFFQNYDSRLYPIPTIYQLTREVYTDPVINITDYRVTPSFESIENSAIRSPHLMDFLNNIIIDTDLIRGVHYWAGHRVTSHFTGSSQVISSPQYGITANAEPSRTIAPSTFPGLNLFYRTLSDPFFRRSDNIMPTLGINVVQGVGFIQPNNGEVLYRRRGTVDSLDELPIDGENSLVGYSHRLSHVTLTRSLYNTNITSLPTFVWTHHSATDRNIIYPDVITQIPLVKSFSLTSGTSVVRGPGFTGGDIIRTNVNGNVLSMSLNFSNTSLQRYRVRVRYAASQTMVMRVNVGGSTTFDQGFPSTMSANGSLTSQSFRFAEFPVGISTSGSQTAGISISNNPGRQTFHLDRIEFIPVDATFEAEYDLERAQKAVNSLFTSSNQIELKTDVTDYHIDQVSNLVDCLSDEFCLDEKRELSEKVKHAKRLSDERNLLQDPNFRGINRQPDRGWRGSTDITIQGGDDVFKENYVTLPGTFDECYPTYLYQKIDESKLKAYNRYQLRGYIEDSQDLEIYLIRYNAKHETVNVPGTGSLWPLSVESPIGRCGEPNRCVPHLEWNPDLDCSCRDGEKCAHHSHHFSLDIDVGCTDLQEDLGVWVVFKIKTQEGYARLGNLEFIEEKPLIGEALSRVKRAEKKWRDKREKLQLETKRVYTEAKEAVDALFVDSQYDRLQADTNIGMIHAADRLVHQIHEAYLPELPFIPGINVVIFEELENRISTALSLYDARNVIKNGDFNNGLSCWNVKGHVDVVEQNNHRSVLVVPEWEAEVSQTIRVCPGRGYILRVTAYKEGYGEGCVTIHEIENNTDELKFKNCEEEEVYPTDTGTCNDYTAHQGTAGSTDSCNSRNIRYEDAYEMNTTASVNYKPTYEEERYTDVQGDNHCEYDRGYVNYRPVPAGYVTKELEYFPETDKVWIEIGETEGKFIVDNVELLLMEE

SEQ ID NO: 182 - protein, 1174 aa, Bacillus thuringiensis aizawai EG6346
MENNIQNQCVPYNCLNNPEVEILNEERSTGRLPLDISLSLTRFLLSEFVPGVGVAFGLFDLIWGFITPSDWSLFLLQIEQLIEQRIETLERNRAITTLRGLADSYEIYIEALREWEANPNNAQLREDVRIRFANTDDALITAINNFTLTSFEIPLLSVYVQAANLHLSLLRDAVSFGQGWGLDIATVNNHYNRLINLIHRYTKHCLDTYNQGLENLRGTNTRQWARFNQFRRDLTLTVLDIVALFPNYDVRTYPIQTSSQLTREIYTSSVIEDSPVSANIPNGFNRAEFGVRPPHLMDFMNSLFVTAETVRSQTVWGGHLVSSRNTAGNRINFPSYGVFNPGGAIWIADEDPRPFYRTLSDPVFVRGGFGNPHYVLGLRGVAFQQTGTNHTRTFRNSGTIDSLDEIPPQDNSGAPWNDYSHVLNHVTFVRWPGEISGSDSWRAPMFSWTHRSATPTNTIDPERITQIPLVKAHTLQSGTTVVRGPGFTGGDILRRTSGGPFAYTIVNINGQLPQRYRARIRYASTTNLRIYVTVAGERIFAGQFNKTMDTGDPLTFQSFSYATINTAFTFPMSQSSFTVGADTFSSGNEVYIDRFELIPVTATFEAEYDLERAQKAVNALFTSINQIGIKTDVTDYHIDQVSNLVDCLSDEFCLDEKRELSEKVKHAKRLSDERNLLQDPNFKGINRQLDRGWRGSTDITIQRGDDVFKENYVTLPGTFDECYPTYLYQKIDESKLKPYTRYQLRGYIEDSQDLEIYLIRYNAKHETVNVLGTGSLWPLSVQSPIRKCGEPNRCAPHLEWNPDLDCSCRDGEKCAHHSHHFSLDIDVGCTDLNEDLDVWVIFKIKTQDGHARLGNLEFLEEKPLVGEALARVKRAEKKWRDKREKLELETNIVYKEAKESVDALFVNSQYDQLQADTNIAMIHAADKRVHRIREAYLPELSVIPGVNVDIFEELKGRIFTAFFLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTANQEEYGGAYTSRNRGYDETYGSNSSVPADYASVYEEKSYTDGRRDNPCESNRGYGDYTPLPAGYVTKELEYFPETDKVWIEIGETEGTFIVDSVELLLMEE

SEQ ID NO: 183 - protein, 1174 aa, Bacillus thuringiensis aizawai PS81I; identical to SEQ ID NO: 182

SEQ ID NO: 184 - protein, 1174 aa, Bacillus thuringiensis BTS00349A
MKNNIQNQCVPYNCLSNPEVEILSEERSTGRLPLDISLSLTRFLLSEFVPGVGVAFGLFDLIWGFITPSEWSLFLLQIEQLIEQRIETLERNRAITTLRGLADSYEVYLEALREWEENPNNAQLREDVRIRFANTDDALITAINNFTLTSFEIPLLSVYVQAANLHLSLLRDAVSFGQGWGLDIATVNNHYNRLINLIHRYTEHCLDTYNQGLENLRGTNTRQWSRFNQFRRELTLTVLDIVALFPNYDARAYPIQTSSQLTREIYTSSVIEDSPVSANIPNGFNRAEFGVRPPHLMDFMNSLFVTAETVRSQTVWGGHLVSSRNTAGNPINFPIYGIFNPGGAIWIADEDPRPFYRTLSDPVFVRGGFGNPHYVLGLRGVAFQQTGTNHTRTFRNSGTIDSLDEIPPQDNSGAPWNDYSHVLNHVTFVRWPGEIAGSDSWRAPMFSWTHRSADRTNIINPNIITQIPAVKAHNLHSGSTVVRGPGFTGGDLLRRTNTGTFADIRVNITGPLSQRYRVRIRYASTTDLQFFTRINGTSVNQGNFQRTMNRGGNLESGNFRTAGFSTPFSFSNAQSTFTLGTQAFSNQEVYIDRIEFVPAEVTFEAESDLERAQKAVNALFTSTSQLGLKTNVTGYHIDQVSNLVACLSDEFCLDEKRELSEKVKHAKRLSDKRNLLQDPNFRGINRQPDHGWRGSTDITIQGGDDVFKENYVTLPGTFDECYPTYLYQKIDESKLKAYTRYQLRGYIEDSQDLEIYLIRYNSKHEIVNVPGTGSLWPLSVENQIGPCGEPNRCAPHLEWNPDLHCSCRDGEKCVHHSHHFSLDIDVGCTDLNEDLGVWLIFKIKTQDGHARLGNLEFLEEEPLLGEALARVKRAEKKWRDKREKLQLETNIVYKEAKESVDALFVNSQYDRLQADTNIAMIHAADKRVHRIREAYLPELSVIPGVNAAIFEELEGRIFTAYSLYDARNVIKNGNFNNGLLCWNVKGHVDVEEQNNHRSVLVIPEWEAEVSQKVRVCPGRGYILRVTAYKEGYGEGCVTIHEIEDNTDELKFSNCVEEGYPNNTVTCNEYTMNQGVGECTDACNVRNRGYEDAYGHNPSTPVHYTTPYEEETYTDERRENPCEANKGYVNYTPLPVGYVTKELEYFPETDTVWIEIGETEGTFIVDSVELLLMEE

SEQ ID NO: 185 - protein, 1168 aa, Bacillus thuringiensis morrisoni INA67
MKNNIQNQCVPYNCLSNPEVEILSEERSTGRLPLDISLSLTRFLLSEFVPGVGVAFGLFDLIWGFITPSEWSLFLLQIEQLIEQRIETLERNRAITTLRGLADSYEVYLEALREWEENPNNAQLREDVRIRFANTDDALITAINNFTLTSFEIPLLSVYVQAANLHLSLLRDAVSFGQGWGLDIATVNNHYNRLINLIHRYTEHCLDTYNQGLENLRGTNTRQWSRFNQFRRELTLTVLDIVALFPNYDARAYPIQTSSQLTREIYTSSVIEDSPVSANIPNGFNRAEFGVRPPHLMDFMNSLFVTAETVRSQTVWGGHLVSSRNTAGNPINFPIYGIFNPGGAIWIADEDPRPFYRTLSDPVFVRGGFGNPHYVLGLRGVAFQQTGTNHTRTFRNSGTIDSLDEIPPQDNSGAPWNDYSHVLNHVTFVRWPGEIAGSDSWRAPMFSWTHRSADRTNIINPNIITQIPAVKAHNLHSGSTVVRGPGFTGGDLLRRTNTGTFADIRVNITGPLSQRYRVRIRYASTTDLQFFTRINGTSVNQGNFQRTMNRGGNLESGNFRTAGFSTPFSFSNAQSTFTLGTQAFSNQEVYIDRIEFVPAEVTFEAESDLERAQKAVNALFTSTSQLGLKTNVTGYHIDQVSNLVACLSDEFCLDEKRELSEKVKHAKRLSDKRNLLQDPNFRGINRQPDHGWRGSTDITIQGGDDVFKENYVTLPGTFDECYPTYLYQKIDESKLKAYTRYQLRGYIEDSQDLEIYLIRYNSKHEIVNVPGTGSLWPLSVENQIGPCGEPNRCAPHLEWNPDLHCSCRDGEKCVHHSHHFSLDIDVGCTDLNEDLGVWLIFKIKTQDGHARLGNLEFLEEEPLLGEALARVKRAEKKWRDKREKLQLETNIVYKEAKESVDALFVNSQYDRLQADTNIAMIHAADKRVHRIREAYLPELSVIPGVNAAIFEELEGRIFTAYSLYDARNVIKNGNFNNGLLCWNVKGHVDVEEQNNHRSVLVIPEWEAEVSQKVRVCPGRGYILRVTAYKEGYGEGCVTIHEVDNNTDELKFSNCEKEQVYPGNTVACNDYNKNHGANACSSRNRGYDESYESNSSIPADYAPVYEEEAYTDGQRGNPCEFNRGHTPLPAGYVTAELEYFPETDTVWVEIGETEGTFIVDSVELLLMEE

SEQ ID NO: 186 - protein, 1169 aa, Bacillus thuringiensis morrisoni
MKNNIQNQCVPYNCLSNPEVEILSEERSTGRLPLDISLSLTRFLLSEFVPGVGVAFGLFDLIWGFITPSEWSLFLLQIEQLIEQRIETLERNRAITTLRGLADSYEVYLEALREWEENPNNAQLREDVRIRFANTDDALITAINNFTLTSFEIPLLSVYVQAANLHLSLLRDAVSFGQGWGLDIATVNNHYNRLINLIHRYTEHCLDTYNQGLENLRGTNTRQWSRFNQFRRELTLTVLDIVALFPNYDARAYPIQTSSQLTREIYTSSVIEDSPVSANIPNGFNRAEFGVRPPHLMDFMNSLFVTAETVRSQTVWGGHLVSSRNTAGNPINFPIYGVFNPGGAIWIADEDPRPFYRTLSDPVFVRGGFGNPHYVLGLRGVGFQQTGTNHTRTFRNSGTIDSLDEIPPQDNSGAPWNDYSHVLNHVTFVRWPGEIAGSDSWRAPMFSWTHRSADRTNIINPNIITQIPAVKAHNLHSGSTVVRGPGFTGGDLLRRTNTGTFADIRVNITGPLSQRYRVRIRYASTTDLQFFTRINGTSVNQGNFQRTMNRGGNLESGNFRTAGFSTPFSFSNAQSTFTLGTQAFSNQEVYIDRIEFVPAEVTFEAESDLERAQKAVNALFTSTSQLGLKTNVTGYHIDQVSNLVACLSDEFCLDEKRELSEKVKHAKRLSDKRNLLQDPNFRGINRQPDHGWRGSTDITIQGGDDVFKENYVTLPGTFDECYPTYLYQKIDESKLKAYTRYQLRGYIEDSQDLEIYLIRYNSKHEIVNVPGTGSLWPLSVENQIGPCGEPNRCAPHLEWNPDLHCSCRDGEKCVHHSHHFSLDIDVGCTDLNEDLGVWLIFKIKTQDGHARLGNLEFLEEEPLLGEALARVKRAEKKWRDKREKLQLETNIVYKEAKESVDALFVNSQYDRLQADTNIAMIHAADKRVHRIREAYLPELSVIPGVNAAIFEELEGRIFTAYSLYDARNVIKNGNFNNGLLCWNVKGHVDVEEQNNHRSVLVVPEWEAEVSQEVRVCPGRGYILRVTAYKEGYGEGCVTIHEVDNNTDELKFSSNCEKEQVYPGNTVACNDYNKNHGANACSSRNGGYDESYESNSSIPADYAPVYEEEAYTDGQRGNPCEFNRGHTPLPAGYVTAELEYFPETDTVWVEIGETEGTFIVDSVELLLMEE

SEQ ID NO: 187 - protein, 1174 aa, Bacillus thuringiensis B-Pr-88; identical to SEQ ID NO: 184

SEQ ID NO: 188 - protein, 1168 aa, Bacillus thuringiensis 012
MENNIQNQCVPYNCLSNPEVEILSEERSTGRLPLDISLSLTRFLLSEFVPGVGVAFGLFDLIWGFITPSEWSLFLLQIEQLIEQRIETLERNRAITTLRGLADSCEVYLEALREWEENPNNAQLREDVRIRFANTDDALITAINNFTLTSFEIPLLSVYVQAANLHLSLLRDAVSFGQGWGLDIATVNNHYNRLINLIHRYTEHCLDTYNQGLENLRGTNTRQWSRFNQFRRELTLTVLDIVALFPNYDARAYPIQTSSQLTREIYTSSVIEDSPVSANIPNGFNRAEFGVRPPHLMDFMNSLFVTAETVRSQTVWGGHLVSSRNTAGNPINFPIYGVFNPGGAIWIADEDPRPFYRTLSDPVFVRGGFGNPHYVLGLRGVGFQQTGTNHTRTFRNSGTIDSLDEIPPQDNSGAPWNDYSHVLNHVTFVRWPGEIAGSDSWRAPMFSWTHRSADRTNIINPNIITQIPAVKAHNLHSGSTVVRGPGFTGGDLLRRTNTGTFADIRVNITGPLSQRYRVRIRYASTTDLQFFTRINGTSVNQGNFQRTMNRGDNLESGNFRTAGFSTPFSFSNAQSTFTLGTQAFSNQEVYIDRIEFVPAEVTFEAESDLERAQKAVNALFTSTSQLGLKTNVTGYHIDQVSNLVACLSDEFCLDEKRELSEKVKHAKRLSDKRNLLQDPNFRGINRQPDHGWRGSTDITIQGGDDVFKENYVTLPGTFDECYPTYLYQKIDESKLKAYTRYQLRGYIEDSQDLEIYLIRYNSKHEIVNVPGTGSLWPLSVENQIGPCGEPNRCAPHLEWNPDLHCSCRDGEKCVHHSHHFSLDIDVGCTDLNEDLGVWLIFKIKTQDGHARLGNLEFLEEEPLLGEALARVKRAEKKWRDKREKLQLETNIVYKEAKESVDALFVNSQYDRLQADTNIAMIHAADKRVHRIREAYLPELSVIPGVNAAIFEELEGRIFTAYSLYDARNVIKNGNFNNGLLCWNVKGHVDVEEQNNHRSVLVVPEWEAEVSQEVRVCPGRGYILRVTAYKEGYGEGCVTIHEVDNNTDELKFSSCEKEQVNPGNTVACNDYNKNHGANACSSRSRGYDESYESNSSIPADYAPVYEEEAYTDGQRGNPCEFNRGHTPLPAGYVTAELEYFPETDTVWVEIGETEGTFIVDSVELLLMEE

SEQ ID NO: 189 - protein, 1174 aa, Bacillus thuringiensis 087
MENNIQNQCVPYNCLSNPEVEILSEERSTGRLPLDISLSLTRFLLSEFVPGVGVAFGLFDLIWGFITPSEWSLFLLQIEQLIEQRIETLERNRAITTLRGLADSYEVYLEALREWEENPNNAQLREDVRIRFANTDDALITAINNFTLTSFEIPLLSVYVQAANLHLSLLRDAVSFGQGWGLDIATVNNHYNRLINLIHRYTEHCLDTYNQGLENLRGTNTRQWSRFNQFRRELTLTVLDIVALFPNYDAGAYPIQTSSQLTREIYTSSVIEDSPVSANIPNGFNRAEFGVRPPHLMDFMNSLFVTAETVRSQTVWGGHLVSSRNTAGNPINFPIYGIFNPGGAIWIADEDPRPFYRTLSDPVFVRGGFGNPHYVLGLRGVAFQQTGTNHTRTFRNSGTIDSLDEIPPQDNSGAPWNDYSHVLNHVTFVRWPGEIAGSDSWRAPMFSWTHRSADRTNIINPNIITQIPAVKAHNLHSGSTVVRGPGFTGGDLLRRTNTGTFADIRVNITGPLSQRYRVRIRYASTTDLQFFTRINGTSVNQGNFQRTMNRGGNLESGNFRTAGFSTPFSFSNAQSTFTLGTQAFSNQEVYIDRIEFVPAEVTFEAESDLERAQKAVNALFTSTSQLGLKTNVTGYHIDQVSNLVACLSDEFCLDEKRELSEKVKHAKRLSDKRNLLQDPNFRGISRQPDHGWRGSTDITIQGGDDVFKENYVTLPGTFDECYPTYLYQKIDESKLKAYTRYQLRGYIEDSQDLEIYLIRYNSKHEIVNVPGTGSLWPLSVENQIGPCGEPNRCAPHLEWNPDLHCSCRDGEKCVHHSHHFSLDIDVGCTDLNEDLGVWLIFKIKTQDGHARLGNLEFLEEEPLLGEALARVKRAEKKWRDKREKLQLETNIVYKEAKESVDALFVNSQYDRLQADTNIAMIHAADKRVHRIREAYLPELSVIPGVNAAIFEELEGRIFTAYSLYDARNVIKNGNFNNGLLCWNVKGHVDVEEQNNHRSVLVIPEWEAEVSQKVRVCPGRGYILRVTAYKEGYGEGSVTIHEIEDNTDELKFSNCVEEGYPNNTVTCNEYTMNQGVGECTDACNVRNRGYEDAYGHNPSTPVHYTTPYEEETYTDERRENPCEANKGYVNYTPLPVGYVTKELEYFPETDKVWVEIGETEGTFIVDSVELLLMEE

SEQ ID NO: 190 - protein, 1166 aa, Bacillus thuringiensis BTS0349A
MEISDQNQYIPYNCLNNPESEIFNARNSNFGLVSQVSSGLTRFLLEAAVPEAGFALGLFDIIWGALGVDQWSLFLRQIEQLIRQEITELERNRATAILTGLSSSYNLYVEALREWENDPNNPASQERVRTRFRLTDDAIVTGLPTLAIRNLEVVNLSVYTQAANLHLSLLRDAVYFGERWGLTQANIEDLYTRLTSNIQEYSDHCARWYNQGLNEIGGISRRYLDFQRDLTISVLDIVALFPNYDIRTYPIPTQSQLTREIYTSPVVAGNINFGLSIANVLRAPHLMDFIDRIVIYTNSVRSTPYWAGHEVISRRTGQGQGNEIRFPLYGVAANAEPPVTIRPTGFTDEQRQWYRARSRVVSFRSSGQDFSLVDAVGFLTIFSAVSIYRNGFGFNTDTIDEIPIEGTDPFTGYSHRLCHVGFLASSPFISQYARAPIFSWTHRSATLTNTIAPDVITQIPLVKAFNLHSGATIVKGPGFTGGDILRRTNVGSFGDMRVNITAPLSQRYRVRIRYASTTDLQFYTNINGTTINIGNFSSTMDSGDDLQYGRFRVAGFTTPFTFSDANSTFTIGAFGFSPNNEVYIDRIEFVPAEVTFEAEYDLEKAQKAVNALFTSSNQIGLKTDVTDYHIDKVSNLVECLSDEFCLDEKRELSEKVKHAKRLSDERNLLQDPNFRGINRQPDRGWRGSTDITIQGGDDVFKENYVTLPGTFDGCYPTYLYQKIDESKLKVYTRYQLRGYIEDSQDLEIYLIRYNAKHETVNVPGTGSLWPLSAQSPIGKCGEPNRCAPHLEWNPDLDCSCRNGEKCAHHSHHFSLDIDVGCTDLNEDLGVWVIFKIKTQDGHARLGNLEFLEEKPLLGEALARVKRAEKKWRDKREKLELETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTANQEEYKGAYTSHNRGYDEAYGNNPSVPADYTPVYEEKAYTDGRRENPCESNRGYGDYTPLPAGYVTKELEYFPETDKVWIEIGETEGTFIVESVELLLMEE

SEQ ID NO: 191 - protein, 1173 aa, Bacillus thuringiensis wuhanensis
MEISDQNQYIPYNCLNNPESEIFNARNSNFGLVSQVSSGLTRFLLEAAVPEAGFALGLFDIIWGALGVDQWSLFLRQIEQLIRQEITELERNRATAILIGLSSSYNLYVEALREWENDPNNPASQERVRTRFRLTDDAIVTGLPTLAIRNLEVVNLSVYTQAANLHLSLLRDAVYFGERWGLTQANIEDLYTRLTSNIQEYSDHCARWYNQGLNEIGGISRRYLDFQRDLTISVLDIVAPFSPNYDIRTYPIPTQSQLTREIYTSPVVAGNINFGLSIANVLRAPHLMDFIDRIVIYTNSVRSTPYWAGHEVISRRTGQAQGNEIRFPLYGVAANAEPPVTIRPTGFTDEQRQWYRARSLLSRFRSSGQDFSLVDAVAFLTIFSAVSIYRNGFGFNTDTIDEIPIEGTDPFTGYSHRLCHVGFLASSPFISQYARAPIFSWTHRSATLTNTIAPDVITQIPLVKAFNLHSGATIVKGPGFTGGDILRRTNVRSFRDMRVNITAPLSQRYRVRIRYASTTDLQFYTNINGTTINIGNFSSTMDSGDDLQYGRFRVAGFTTPFTFSRCKQTFHNRSFWFSPKLTEVYIDRIEFVPAEVTFEAEYDLEKAQKAVNALFTSSNQIGLKTDVTDYHIDKVSNLVECLSDEFCLDEKRELSEKVKHAKRLSDERNLLQDPNFRGINRQPDRGWRGSTDITIQGGDDVFKENYVTLPGTFDGCYPTYLYQKIDESKLKAYTRYQLRGYIEDSQDLEIYLIRYNAKHETVNVPGTGSLWPLSAQSPIGKCGEPNRCAPHLEWNPYLDCSCRNGKKCAHHSHHFSLDIDVGCTDLNEDLGVWVIFKIKTQDGHARLGNLEFLEEKPLLGEALARVKRAEKKWRDKREKLELETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHESRTIQRTEIQQLLEEEVYPNNTVTCNDYTANQEEYKGAYTSHNRGYDEAYGNNPSVPADYTPVYEEKAYTDGRRDNPCESNRGYGDYTPLPAGYVSKELEYFPETDKVWIEIGETEGTFIVESVNYSLWRNRIRFKM

SEQ ID NO: 192 - protein, 1169 aa, Bacillus thuringiensis wuhanensis HD525
MEINNQNQCVPYNCLNNPESEILNVAIFSSEQVAEIHLKITRLILENFLPGGSFAFGLFDLIWGIFNEDQWSAFLRQVEELINQRITEFARGQAIQRLVGFGRSYDEYILALKEWENDPDNPASKERVRTRFRTTDDALLTGVPLMAIPGFELATLSVYAQSANLHLALLRDAVFFGERWGLTQTNINDLYSRLKNSIRDYTNHCVRFYNIGLGNLNVIRPEYYRFQRELTISVLDLVALFPNYDIRTYPIPTKSQLTREIYTDPIISPGAQAGYTLQDVLREPHLMDFLNRLIIYTGEYRGIRHWAGHEVESSRTGMMTNIRFPLYGTAATAEPTRFITPSTFPGLNLFYRTLSAPIFRDEPGANIIIRYRTSLVEGVGFIQPNNGEQLYRVRGTLDSLDQLPLEGESSLTEYSHRLCHVRFAQSLRNAEPLDYARVPMFSWTHRSATPTNTIDPDVITQIPLVKAFNLHSGATVVRGPGFTGGDILRRTNAGNFGDMRVNITAPLSQRYRVRIRYASTANLQFHTSINGRAINQANFPATMNSGENLQSGSFRVAGFTTPFTFSDALSTFTIGAFSFSSNNEVYIDGIEFVPAEVTFATESDQDRAQKAVNALFTSSNQIGLKTDVTNYHIDQVSNLVECLSDEFCLDEKRELSEKVKHAKRLCDERNLLQDPNFRGINREPDRGWRGSTDITIQRGDDVFKENYVTLPGTFDECYPTYLYQKIDESKLKAYTRYELRGYIEDSQDLEIYLIRYNAKHETVNVPGTGSLWPLSAQSPIGKCGEPNRCATHLEWNPDLDCSCRDGEKCAHHSHHFSLDIDVGCTDLNEDLGVWVIFKIKTQDGHARLGNLEFLEEKPLLGEALARVKRAEKKWRDKREKLELETNIVYKEAKKSVDALFVNSQYDRLQADTNIAIIHAADKRVHSIREAYLPELSVIPGVNAAIFEELEGRIFTAYSLYDARNVIKNGDFNNGLSCWNVKGHVDVEEQNNHRSVLVVPEWEAEVSQEVRVCPGRGYILRVTAYKEGYGEGCVTIHEIEDNTDELKFSNCVEEEIYPNNTVTCNDYTATQEEYEGTYTSRNRGYDGAYESNSSVPADYASAYEEKAYTDGRRDNTCESNRGYGDYTPLPAGYVTKELEYFPETDKVWIEIGETEGTFIVDSVELLLMEE

SEQ ID NO: 193 - protein, 1169 aa, Bacillus thuringiensis B-Pr-88
MEINNQNQCVPYNCLNNPESEILNVAIFSSEQVAEIHLKITRLILENFLPGGSFAFGLFDLIWGIFNEDQWSAFLRQVEELINQRITEFARGQAIQRLVGFGRSYDEYILALKEWENDPDNPASKERVRTRFRTTDDALLTGVPLMAIPGFELATLSVYAQSANLHLALLRDAVFFGERWGLTQTNINDLYSRLKNSIRDYTNHCVRFYNIGLGNLNVIRPEYYRFQRELTISVLDLVALFPNYDIRTYPIPTKSQLTREIYTDPIISPGAQAGYTLQDVLREPHLMDFLNRLIIYTGEYRGIRHWAGHEVESSRTGMMTNIRFPLYGTAATAEPTRFITPSTFPGLNLFYRTLSAPIFRDEPGANIIIRYRTSLVEGVGFIQPNNGEQLYRVRGTLDSLDQLPLEGESSLTEYSHRLCHVRFAQSLRNAEPLDYARVPMFSWTHRSATPTNTIDPDVITQIPLVKAFNLHSGATVVRGPGFTGGDILRRTNAGNFGDMRVNITAPLSQRYRVRIRYASTANLQFHTSINGRAINQANFPATMNSGENLQSGSFRVAGFTTPFTFSDALSTFTIGAFSFSSNNEVYIDRIEFVPAEVTFATESDQDRAQKAVNALFTSSNQIGLKTDVTNYHIDQVSNLVECLSDEFCLDEKRELSEKVKHAKRLCDERNLLQDPNFRGINREPDRGWRGSTDITIQRGDDVFKENYVTLPGTFDECYPTYLYQKIDESKLKAYTRYELRGYIEDSQDLEIYLIRYNAKHETVNVPGTGSLWPLSAQSPIGKCGEPNRCATHLEWNPDLDCSCRDGEKCAHHSHHFSLDIDVGCTDLNEDLGVWVIFKIKTQDGHARLGNLEFLEEKPLVGEALARVKRAEKKWRDKREKLELETNIVYKEAKKSVDALFVNSQYDRLQADTNIAIIHAADKRVHSIREAYLPELSVIPGVNAAIFEELEGRIFTAYSLYDARNVIKNGDFNNGLSCWNVKGHVDVEEQNNHRSVLVVPEWEAEVSQEVRVCPGRGYILRVTAYKEGYGEGCVTIHEIEDNTDELKFSNCVEEEIYPNNTVTCNDYTATQEEYEGTYTSRNRGYDGAYESNSSVPADYASAYEEKAYTDGRRDNTCESNRGYGDYTPLPAGYVTKELEYFPETDKVWIEIGETEGTFIVDSVELLLMEE

SEQ ID NO: 194 - protein, 1167 aa, Bacillus thuringiensis
MERNNQDQCIPYNCLNNPEIEILDVENFNLELVSQVSVGLTRFLLESAVPGAGFALGLFDIIWGALGVDQWSLFLAQIEQLINERITTVERNRAIQTLSGLSSSYEVYIEALREWENNPDNPASQERVRTRFRTTDDALITAIPNLAIPDFEIATLSVYVQAANLHLSLLRDAVYFGERWGLTQVNIEDLYTRLTRNIHIYSDHCARWYNQGLNNIGATNTRYLEFQRELTLSVLDIVALFPNYDIRTYSIPTQSQLTREIYTDIIAAPNASNLIVGTQGLVRAPHLMDFLVRLNIYTGLARNIRHWAGHEVISRRTGGVDLNTIQSPLYGTAATTESPRLIIPFNEDSYLGGFIYRTLSSPIYVPPSGISSQRTSLVEGVGFQTPNNSILQYRQRGTLDSLEQVPLQEEGRPGGFGASHRLCHATFAQSPIGTNYYIRAPLFSWTHLSATLTNEVRVSRITQLPMVKAHTLHAGATVVRGPGFTGGDILRRTTSGSFGDMRITNFSSSSSRYRVRIRYASTTDLQFFLNVGGTPVNVADFPKTIDRGENLEYGSFRTAGFTTPFSFVSSTNNFTLGVQSVSSGNEIFVDRIEFVPADATFEAEYDLERAQEAVNALFTSTNQRGLKTDVTDYHIDQVSNLVDCLSDEFCLDEKRELSEKIKHAKRLSDERNLLQDSNFRGINRQPDRGWRGSTDITIQGGNDVFKENYVTLPGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 195 - protein, 1172 aa, Bacillus thuringiensis BTS02069AA
MEIINNQNQYVPYNCLSNPENEILDIESLSSRSREQVAEISLGLTRFLLESLLPGASFGFALFDIIWGVIGPDQWNLFLAQIEQLIDQRIEAHVRNQAISRLEGLGDSYEVYIESLREWEASPNNEALQQDVRNRFSNTDNALITAIPILREQGFEIPLLSVYVQAANLHLSLLRDAVYFGQRWGLDTVTVNNHYNRLINLINTYSDHCAQWFNRGLDNFGGVSARYLDFQREVTISVLDIVALFPNYDIRTYPISTQSQLTREIYTSPVAEPGASLNANLQNILREPHLMDFLTRLVIYTGVQSGIYHWAGHEISSRTTGNLSSNIQFPLYGTAASADRAFNMNIHHSETIYRTLSAPIYSVSGGISPNRTRVVEGVRFLIARDNNLDSLPFLYRKEGTLDSFTELPPEDESTPPYIGYSHRLCHARFARSPVILEPSNFARLPVFSWTHRSASPTNEVSPSRITQIPWVKAHTLASGASVIKGPGFTGGDIMTRNNINLGDLGTLRVTVTGRLPQSYYIRLRYASVANSSGVFRHLPQPSYGISFPRTMGTDEPLTSRSFALTTLFTPITLTRAQEEFNLTIPRGVYIDRIEFVPVDATFEAGYDLERAQKAVNALFTSTNQRGLKTDITDYHIDQVSNLVECLSDEFCLDEKRELSEKVKHAKRLSDGRNLLQDRNFISINGLLDRGWRGSTDITIQGSDDVFKENYVTLPGTFDECYPTYLYQKIDESKLKAYTRYQLRGYIEDSQDLEIYLIRYNAKHEIVNVPGTGSLWPLSVENSIGPCGESNRCAPHLEWNPNLDCSCRDGEKCAHHSHHFSLDIDVGCTDLNEDLGVWVIFKIKTQDGHARIGNLEFLEEKPLVGEALARVKRAEKKWRDKRKKLEFETNIVYKEAKESVDALFVNSQYDKLKADTNIAMIHAADKRVHRIREAYLPELSVIPGVNADIFEELEGRIFTAYSLYDARNVIKNGDFNNGLLCWNVKGHVDVEEQNNHRSVLVVPEWEAEVSQEVRVCPGRGYILRVTAYKEGYGEGCVTIHEIEDNTDELKFSNCVEEEVYPSNTVTCNDYTANQEEYEGTYTSRNQGYDEAYESNSSVPANYASVYEEKAYTDGRRENSCEFNRGYRDYTPLPAGYVTKELEYFPGTAKVWIEIGETEGTFIVDSVELLLMEE

SEQ ID NO: 196 - protein, 1155 aa, Bacillus thuringiensis morrisoni BF190
MEVNHQNECVPYNCLKNPKIEMLDIEGISSRSREQVAEISLGLTRFLLESLLPGASFGFGLFDIIWGVIGPDQWSLFLTQIEQLIDQRIEAHVRNQAISRLEGLGDSYEVYIESLREWEASPNNESLQQDVRNRFSNTDNALITAIPILREQGFEIPLLTVYVQAANLHLSLLRDAVYFGQRWGLDTATVNNHYNRLINLINTYSDHCAQWFNRGLDNFGVVTARYLDFQREVTISVLDIVALFPNYDIRTYPIQTLSQLTREIYTSPVAEPGASLNVDLRNILREPHLMDFLTRLVIYTGVQGGIYHWAGHEISSRTTGNLSSNIQFPLYGTSANADRPFNLAIHYSETIYRTLSAPIYSVSGGISPNRTRAVEGVRFLTARDNNLNSLPFLYRKEGSLDSFTELPPEDENEPPYIGYSHRLCHARFARSSVVLEPSNFARIPVFSWTHRSAGPTNEVSSSRITQIPWVKAHTLDSGAFVIKGPGFTGGDILTRPNLGTLGALRVTLTGQLPQTYNIRIRYASIANRGGTLIFSQPPSYGLTFPKTMDIDEPLTSRSFARTTLFTPITFTQAQAELNLTIQQGVYIDRIEFIPVNATFEAEYDLERAQEAVNALFTSSNQLGLKTDLTDYHIDQVSNLVDCLSDEFCIDEKRELSEKVKHAKRLSDERNLLQDSNFRGINRQPDRGWRGSTDITIQGGNDVFKENYVTLPGTFDECYPTYLYQKIDESKLKAYTRYQLRGYIEDSQDLEIYLIRYNAKHETVNVPGTGSLWPLSVESPIGKCGEPNRCVPQLEWNSNLDCSCRDGEKCAHHSHHFSLDIDVGCTDLNEDLGVWVIFKIKTQDGHARLGNLEFLEEKPLLGEALARVKRAEKKWRDKRETLQLETNIVYKEAKESVDALFANSQYNRLQADTNIAMIHAADKRVHRIREAYLPELSVIPGVNAGIFEELEGRIFTAFSLYDARNVIKNSDFNNGLSCWNVKGHVDIEEQNNHRSVLVVPEWEAEVSQKVHVCPGRGYILRVTAYKEGYGEGCVTIHEIEDHTDELKFRNCEEDEVYPNNTRTCNAYPADQEGYEGACTSRNRGYDEVYGNTPSLPADYAPIYEENAYTDGRRGNPCESSRGYGDYTPLPAGYETKELEYFPETDTVWPRNRYSVD

SEQ ID NO: 197 - protein, 140 aa, Bacillus thuringiensis JC291
QCVPYNCLSNPENEILDIESLSSRSREQVAEISLGLTRFLLESLLPGASFGFALFDIIWGVIGPDQWNLFLAQIEQLIDQRIEAHVRNQAISRLEGLGDSYEVYIESLREWEGSPNNEGLQQDVRNRFSNTDNALITGYL

SEQ ID NO: 198 - protein, 719 aa, Bacillus thuringiensis kurstaki
MKLKNQDKHQSFSSNAKVDKISTDSLKNETDIELQNINHEDCLKMSEYENVEPFVSASTIQTGIGIAGKILGTLGVPFAGQVASLYSFILGELWPKGKNQWEIFMEHVEEIINQKISTYARNKALTDLKGLGDALAVYHDSLESWVGNRNNTRARSVVKSQYIALELMFVQKLPSFAVSGEEVPLLPIYAQAANLHLLLLRDASIFGKEWGLSSSEISTFYNRQVERAGDYSYHCVKWYSTGLNNLRGTNAESWVRYNQFRRDMTLMVLDLVALFPSYDTQMYPIKTTAQLTREVYTDAIGTVHPHPSFTSTTWYNNNAPSFSAIEAAVVRNPHLLDFLEQVTIYSLLSRWSNTQYMNMWGGHKLEFRTIGGTLNISTQGSTNTSINPVTLPFTSRDVYRTESLAGLNLFLTQPVNGVPRVDFHWKFVTHPIASDNFYYPGYAGIGTQLQDSENELPPEATGQPNYESYSHRLSHIGLISASHVKALVYSWTHRSADRTNTIEPNSITQIPLVKAFNLSSGAAVVRGPGFTGGDILRRTNTGTFGDIRVNINPPFAQRYRVRIRYASTTDLQFHTSINGKAINQGNFSATMNRGEDLDYKTFRTVGFTTPFSFLDVQSTFTIGAWNFSSGNEVYIDRIEFVPVEVTYEAEYDFEKAQEKVTALFTSTNPRGLKTDVKDYHIDQVSNLVESLSDEFYLDEKRELFEIVKYAKQLHIERNM

SEQ ID NO: 199 - protein, 719 aa, Bacillus thuringiensis thuringiensis
MKLKNQDKHQSFSSNAKVDKISTDSLKNETDIELQNINHEDCLKMSEYENVEPFVSASTIQTGIGIAGKILGTLGVPFAGQVASLYSFILGELWPKGKNQWEIFMEHVEEIINQKISTYARNKALTDLKGLGDALAVYHDSLESWVGNRNNTRARSVVKSQYIALELMFVQKLPSFAVSGEEVPLLPIYAQAANLHLLLLRDASIFGKEWGLSSSEISTFYNRQVERAGDYSDHCVKWYSTGLNNLRGTNAESWVRYNQFRRDMTLMVLDLVALFPSYDTQMYPIKTTAQLTREVYTDAIGTVHPHPSFTSTTWYNNNAPSFSAIEAAVVRNPHLLDFLEQVTIYSLLSRWSNTQYMNMWGGHKLEFRTIGGTLNISTQGSTNTSINPVTLPFTSRDVYRTESLAGLNLFLTQPVNGVPRVDFHWKFVTHPIASDNFYYPGYAGIGTQLQDSENELPPEATGQPNYESYSHRLSHIGLISASHVKALVYSWTHRSADRTNTIEPNSITQIPLVKAFNLSSGAAVVRGPGFTGGDILRRTNTGTFGDIRVNINPPFAQRYRVRIRYASTTDLQFHTSINGKAINQGNFSATMNRGEDLDYKTFRTVGFTTPFSFLDVQSTFTIGAWNFSSGNEVYIDRIEFVPVEVTYEAEYDFEKAQEKVTALFTSTNPRGLKTDVKDYHIDQVSNLVESLSDEFYLDEKRELFEIVKYAKQLHIERNM

SEQ ID NO: 200 - protein, 719 aa, Bacillus thuringiensis kurstaki BNS3
MKLKNQDKHQSFSSNAKVDKISTDSLKNETDIELQNINHEDCLKMSEYENVEPFVSASTIQTGIGIAGKILGTLGVPFAGQVASLYSFILGELWPKGKNQWEIFMEHVEEIINQKISTYARNKALTDLKGLGDALAVYHDSLESWVGNRNNTRARSVVKSQYIALELMFVQKLPSFAVSGEEVPLLPIYAQAANLHLLLLRDASIFGKEWGLSSSEISTFYNRQVERAGDYSDHCVKWYSTGLNNLRGTNAESWVRYNQFRRDMTLMVLDLVALFPSYDTQMYPIKTTAQLTREVYTDAIGTVHPHPSFTSTTWYNNNAPSFSAIEAAVVRNPHLLDFLEQVTIYSLLSRWSNTQYMNMWGGHKLEFRTIGGTLNISTQGSTNTSINPVTLPFTSRDVYRTESLAGLNLFLTQPVNGVPRVDFHWKFVTHPIASDNFYYPGYAGIGTQLQDSENELPPEATGQPNYESYSHRLSHIGLISASHVKALVYSWTHRSADRTNTIEPNSITQIPLVKAFNLSSGAAVVRGPGFTGGDILRRTNTGTFGDIRVNINPPFAQRYRVRIRYASTTDLQFHTSINGKAINQGNFSATMNRGEDLDYKTFRTVGFTTPFSFLDVQSTFTIGAWNFSSGNEVYIDRIEFVPVEVTYEAEYDFEKAQEKVTALFTSTNPRGLKTDVKDYHIDQVSNLVESLSDEFYLDEKRELFEIVKYANELHIERNM

SEQ ID NO: 201 - protein, 719 aa, Bacillus thuringiensis
MKLKNQDKHQSFSSNAKVDKISTDSLKNETDIELQNINHEDCLKMSEYENVEPFVSASTIQTGIGIAGKILGTLGVPFAGQVASLYSFILGELWPKGKNQWEIFMEHVEEIINQKISTYARNKALTDLKGLGDALAVYHDSLESWVGNRNNTRARSVVRSQYIALELMFVQKLPSFAVSGEEVPLLPIYAQAANLHLLLLRDASIFGKEWGLSSSEISTFYNRQVERAGDYSDHCVKWYSTGLNNLRGTNAESWVRYNQFRRDMTLMVLDLVALFPSYDTQMYPIKTTAQLTREVYTDAIGTVHPHPSFTSTTWYNNNAPSFSAIEAAVVRNPHLLDFLEQVTIYSLLSRWSNTQYMNMWGGHKLEFRTIGGTLNISTQGSTNTSINPVTLPFTSRDVYRTESLAGLNLFLTQPVNGVPRVDFHWKFVTHPIASDNFYYPGYAGIGTQLQDSENELPPEATGQPNYESYSHRLSHIGLISASHVKALVYSWTHRSADRTNTIEPNSITQIPLVKAFNLSSGAAVVRGPGFTGGDILRRTNTGTFGDIRVNINPPFAQRYRVRIRYASTTDLQFHTSINGKAINQGNFSATMNRGEDLDYKTFRTVGFTTPFSFLDVQSTFTIGAWNFSSGNEVYIDRIEFVPVEVTYEAEYDFEKAQEKVTALFTSTNPRGLKTDVKDYHIDQVSNLVESLSDEFYLDEKRELFEIVKYAKQLHIERNM

SEQ ID NO: 202 - protein, 719 aa, Bacillus thuringiensis
MKLKNQDKHQSFSSNAKVDKISTDSLKNETDIELQNINHEDCLKMSEYENVEPFVSASTIQTGIGIAGKILGTLGVPFAGQVASLYSFILGELWPKGKNQWEIFMEHVEEIINQKISTYARNKALTDLKGLGDALAVYHDSLESWVGNRNNTRARSVVKSQYIALELMFVQKLPSFAVSGEEVPLLPIYAQAANLHLLLLRDASIFGKEWGLSSSEISTFYNRQVERAGDYSDHCVKWYSTGLNNLRGTNAESWVRYNQFRRDMTLMVLDLVALFPSYDTQMYPIKTTAQLTREVYTDAIGTVHPHPSFTSTTWYNNNAPSFSAIEAAVVRNPHLLDFLEQVTIYSLLSRWSNTQYMNMWGGHKLEFRTIGGTLNISTQGSTNTSINPVTLPFTSRDVYRTESLAGLNLFLTQPVNGVPRVDFHWKFVTHPIASDNFYYPGYAGIGTQLQDSENELPPEATGQPNYESYSHRLSHIGLISASHVKALVYSWTHRSADRTNTIEPNSITQIPLVNAFNLSSGAAVVRGPGFTGGDILRRTNTGTFGDIRVNINPPFAQRYRVRIRYASTTDLQFHTSISGKAINQGNFSATMNRGEDLDYKTSRTVGFTTPFSFLDVQSTFTIGAWNFSSGNEVYIDRIEFVPVEVTYEAEYDFEKAQEKVTALFTSTNPRGLKTDVKDYHIDQVSNLVESLSDEFYLDEKRELFEIVKYAKQLHIERNM

SEQ ID NO: 203 - protein, 719 aa, Bacillus thuringiensis; identical to SEQ ID NO: 199

SEQ ID NO: 204 - protein, 719 aa, Bacillus thuringiensis E-1B
MKLKNQDKHQSFSSNAKVDKISTDSLKNETDIELQNINHEDCLKMSEYENVEPFVSASTIQTGIGIAGKILGTLGVPFAGQVASLYSFILGELWPKGKNQWEIFMEHVEEIINQKISTYARNKALTDLKGLGDALAVYHDSLESWVGNRNNTRARSVVKSQYIALELMVVQKLPSFAVSGEEVPLLPIYAQAANLHLLLLRDASIFGKEWGLSSSEISTFYNRQVERAGDYSDHCVKWYSTGLNNLRGTNAESWVRYNQFRRDMTLMVLDLVALFPSYDTQMYPIKTTAQLTREVYTDAIGTVHPHPSFTSTTWYNNNAPSFSAIEAAVVRNPHLLDFLEQVTIYSLLSRWSNTQYMNMWGGHKLEFRTIGGTLNISTQGSTNTSINPVTLPFTSRDVYRTESLAGLNLFLTQPVNGVPRVDFHWKFVTHPIASDNFYYPGYAGIGTQLQDSENELPPEATGQPNYESYSHRLSHIGLISASHVKALVYSWTHRSADRTNTIEPNSITQIPLVKAFNLSSGAAVVRGPGFTGGDILRRTNTGTFGDIRVNINPPFAQRYRVRIRYASTTDLQFHTSINGKAINQGNFSATMNRGEDLDYKTFRTVGFTTPFSFLDVQSTFTIGAWNFSSGNEVYIDRIEFVPVEVTYEAEYVNEKAQEKVTALFTSTNPRGLKTDVKDYHIDQVSNLVESLSDEFYLDEKRELFEIVKYANELHIERNM

SEQ ID NO: 205 - protein, 719 aa, Bacillus thuringiensis E-1A
MKLKNQDKHQSFSSNAKLDKISTDSLKNETDIELQNINHEDCLKMSEYENVEPFVSASTIQTGIGIAGKILGTLGVPFAGQVASLYSFILGELWPKGKNQWEIFMEHVEEIINQKISTYARNKALTDLKGLGDALAVYHDSLESWVGNRNNTRARSVVKSQYIALELMFVQKLPSFAVSGEEVPLLPIYAQAANLHLLLLRDASIFGKEWGLSSSEISTFYNRQVERAGDYSDHCVKWYSTGLNNLRGTNAESWVRYNQFRRDMTLMVLDLVALFPSYDTQMYPIKTTAQLTREVYTDAIGTVHPHPSFTSTTWYNNNAPSFSAIEAAVVRNPHLLDFLEQVTIYSLLSRWSNTQYMNMWGGHKLEFRTIGGTLNISTQGSTNTSINPVTLPFTSRDVYRTESLAGLNLFLTQPVNGVPRVDFHWKFVTHPIASDNFYYPGYAGIGTQLQDSENELPPEATGQPNYESYSHRLSHIGLISASHVKALVYSWTHRSADRTNTIEPNSITQIPLVKAFNLSSGAAVVRGPGFTGGDILRRTNTGTFGDIRVNINPPFAQRYRVRIRYASTTDLQFHTSINGKAINQGNFSATMNRGEDLDYKTFRTVGFTTPFSFLDVQSTFTIGAWNFSSGNEVYIDRIEFVPVEVTYEAEYDFEKAQEKVTALFTSTNPRGLKTDVKDYHIDQVSNLVESLSDEFYLDEKRELFEIVKYGKGLHIERNM

SEQ ID NO: 206 - protein, 719 aa, Bacillus thuringiensis MX2
MKLKNPDKHQSFSSNAKVDKISTDSLKNETDIELQNINHEDCLKMSEYENVEPFVSASTIQTGIGIAGKILGTLGVPFAGQVASLYSFILGELWPKGKNQWEIFMEHVEEIINQKISTYARNKALTDLKGLGDALAVYHDSLESWVGNRNNTRARSVVKSQYIALELMFVQKLPSFAVSGEEVPLLPIYAQAANLHLLLLRDASIFGKEWGLSSSEISTFYNRQVERAGDYSDHCVKWYSTGLNNLRGTNAESWVRYNQFRRDMTLMVLDLVALFPSYDTQMYPIKTTAQLTREVYTDAIGTVHPHPSFTSTTWYNNNAPSFSAIEAAVVRNPHLLDFLEQVTIYSLLSRWSNTQYMNMWGGHKLEFRTIGGTLNISTQGSTNTSINPVTLPFTSRDVYRTESLAGLNLFLTQPVNGVPRVDFHWKFVTHPIASDNFYYPGYAGIGTQLQDSENELPPEATGQPNYESYSHRLSHIGLISASHVKALVYSWTHRSADRTNTIEPNSITQIPLVKAFNLSSGAAVVRGPGFTGGDILRRTNTGTFGDIRVNINPPFAQRYRVRIRYASTTDLQFHTSINGKAINQGNFSATMNRGEDLDYKTFRTVGFTTPFSFLDVQSTFTIGAWNFSSGNEVYIDRIEFVPVEVTYEAVYDFEKAQEKVTALFTSTNPRGLKTDVKDHHIDQVSNLVESLSDEFYLDEKRELFEIVKYAKQLHIERNM

SEQ ID NO: 207 - protein, 705 aa, Bacillus thuringiensis MX9
MKLKNPDKHQSLSSNAKVDKIATDSLKNETDIELKNMNNEDYLRMSEHESIDPFVSASTIQTGIGIAGKILGTLGVPFAGQIASLYSFILGELWPKGKSQWEIFMEHVEEIINQKILTYARNKALSDLRGLGDALAVYHESLESWVKNRNNTRARSVVKNQYIALELMFVQKLPSFAVSGEEVPLLPIYAQAANLHLLLLRDASIFGKEWGLSASEISTFYNRQVERTRDYSDHCVKWYNTGLNNLRGTNAKSWVRYNQFRKDMTLMVLDLVALFPSYDTLVYPIKTTSQLTREVYTDAIGTVHPNQAFASTTWYNNNAPSFSAIEAAVIRSPHLLDFLEKVTIYSLLSRWSNTQYMNMWGGHRLESRPIGGALNTSTQGSTNTSINPVTLQFTSRDVYRTESWAGLNLFLTQPVNGVPRVDFHWKFPTLPIASDNFYYLGYAGVGTQLQDSENELPPETTGQPNYESYSHRLSHIGLISASHVKALVYSWTHRSADRTNTIEPNSITQIPLVKAFNLPSGAAVVRGPGFTGGDILRRTNTGTFGDIRVNINPPFAQRYRVRIRYASTTDVQFHTSINGKAINQGNFSATMNRGEDLDYKTFRTVGFTTPFSLSDVQSTFTIGAWNFSSGNEVYIDRIEFVPVEVTYEAEHDFEKAQEEVTALFTSTNPGGLKTNVTEYHIDQVSNLVESLSMNSISMKRENYSR

SEQ ID NO: 208 - protein, 719 aa, Bacillus thuringiensis kurstaki; identical to SEQ ID NO: 199

SEQ ID NO: 209 - protein, 719 aa, Bacillus thuringiensis kurstaki HD1
MKLKNQDKHQSFSSNAKVDKISTDSLKNETDIELQNINHEDCLKMSEYENVEPFVSASTIQTGIGIAGKILGTLGVPFAGQVASLYSFILGELWPKGKNQWEIFMEHVEEIINQKISTYARNKALTDLKGLGDALAVYHDSLESWVGNRNNTRARSVVKSQYIALELMFVQKLPSFAVSGEEVPLLPIYAQAANLHLLLLRDASIFGKEWGLSSSEISTFYNRQVERAGDYSYHCVKWYSTGLNNLRGTNAESWVRYNQFRRDMTLMVLDLVALFPSYDTQMYPIKTTAQLTREVYTDAIGTVHPHPSFTSTTWYNNNAPSFSAIEAAVVRNPHLLDFLEQVTIYSLLSRWSNTQYMNMWGGHKLEFRTIGGTLNISTQGSTNTSINPVTLPFTSRDVYRTESLAGLNLFLTQPVNGVPRVDFHWKFVTHPIASDNFYYPGYAGIGTQLQDSENELPPEATGQPNYESYSHRLSHIGLISASHVKALVYSWTHRSADRTNTIEPNSITQIPLVKAFNLSSGAAVVRGPGFTGGDILRRTNTGTFGDIRVNINPPFAQRYRVRIRYASTTDLQFHTSINGKAINQGNFSATMNRGEDLDYKTFRTVGFTTPFSFLDVQSTFTIGAWNFSSGNEVYIDRIEFVPVEVTYEAEYDFEKAQEKVTALFTSTNPRGLKTDVKDYHIDQVSNLVESLSDEFYLDEKRELFEIVKYANELHIERNM

SEQ ID NO: 210 - protein, 719 aa, Bacillus thuringiensis AB88
MKLKNQDKHQSFSSNAKVDKISTDSLKNETDIELQNINHEDCLKMSEYENVEPFVSASTIQTGIGIAGKILGTLGVPFAGQVASLYSFILGELWPKGKNQWEIFMEHVEEIINQKISTYARNKALTDLKGLGDALAVYHDSLESWVGNRNNTRARSVVKSQYIALELMFVQKLPSFAVSGEEVPLLPIYAQAANLHLLLLRDASIFGKEWGLSSSEISTFYNRQVERAGDYSDHCVKWYSTGLNNLRGTNAESWVRYNQFRRDMTLMVLDLVALFPSYDTQMYPIKTTAQLTREVYTDAIGTVHPHPSFTSTTWYNNNAPSFSAIEAAVVRNPHLLDFLEQVTIYSLLSRWSNTQYMNMWGGHKLEFRTIGGTLNISTQGSTNTSINPVTLPFTSRDVYRTESLAGLNLFLTQPVNGVPRVDFHWKFVTHPIASDNFYYPGYVGIGTQLQDSENELPPEATGQPNYESYSHRLSHIGLISASHVKALVYSWTHRSADRTNTIEPNSITQIPLVKAFNLSSGAAVVRGPGFTGGDILRRTNTGTFGDIRVNINPPFAQRYRVRIRYASTTDLQFHTSINGKAINQGNFSATMNRGEDLDYKTFRTVGFTTPFSFLDVQSTFTIGAWNFSSGNEVYIDRIEFVPVEVTYEAEYDFEKAQEKVTALFTSTNPRGLKTDVKDYHIDQVSNLVESLSDEFYLDEKRELFEIVKYAKQLHIERNM

SEQ ID NO: 211 - protein, 719 aa, Bacillus thuringiensis 61
MKLKNQDKHQSFSSNAKVDKISTDSLKNETDIELQNINHEDCLKMSEYENVEPFVSASTIQTGIGIAGKILGTLGVPFAGQVASLYSFILGELWPKGKNQWEIFMEHVEEIINQKISTYARNKALTDLKGLGDALAVYHDSLESWVGNRNNTRARSVVRSQYIALELMFVQKLPSFAVSGEEVPLLPIYAQAANLHLLLLRDASIFGKEWGLSSSEISTFYNRQVERAGDYSDHCVKWYSTGLNNLRGTNAESWVRYNQFRRDMTLMVLDLVALFPSYDTQMYPIKTTAQLTREVYTDAIGTVHPHPSFTSTTWYNNNAPSFSAIEAAVVRNPHLLDFLEQVTIYSLLSRWSNTQYMNMWGGHKLEFRTIGGTLNISTQGSTNTSINPVTLPFTSRDVYRTESLAGLNLFLTQPVNGVPRVDFHWKFVTHPIASDNFYYPGYAGIGTQLQDSENELPPEATGQPNYESYSHRLSHIGLISASHVKALVYSWTHRSADRTNTIEPNSITQIPLVKAFNLSSGAAVVRGPGFTGGDILRRTNTGTFGDIRVNINPPFAQRYRVRIRYASTTDLQFHTSINGKAINQGNFSATMNRGEDLDYKTFRTVGFTTPFSFLDVQSTFTIGAWNFSSGNEVYIDRIEFVPVEVTYEAEYDFEKAQEKVTALFTSTNPRGLKTDVKDYHIDQVSNLVESLSDEFYLDEKRELFEIVKYANELHIERNM

SEQ ID NO: 212 - protein, 719 aa, Bacillus thuringiensis kurstaki S101
MKLKNQDKHQSFSSNAKVDKISTDSLKNETDIELQNINHEDCLKMSEYENVEPFVSASTIQTGIGIAGKILGTLGVPFAGQVASLYSFILGELWPKGKNQWEIFMEHVEEIINQKISTYARNKALTDLKGLGDALAVYHDSLESWVGNRNNTRARSVVKSQYIALELMFVQKLPSFAVSGEEVPLLPIYAQAANLHLLLLRDASIFGKEWGLSSSEISTFYNRQVERAGDYSDHCVKWYSTGLNNLRGTNAESWVRYNQFRRDMTLMVLDLVALFPSYDTQMYPIKTTAQLTREVYTDAIGTVHPHPSFTSTTWYNNNAPSFSAIEAAVVRNPHLLDFLEQVTIYSLLSRWSNTQYMNMWGGHKLEFRTIGGTLNISTQGSTNTSINPVTLPFTSRDVYRTESLAGLNLFLTQPVNGVPRVDFHWKFVTHPIASDNFYYPGYAGIGTQLQDSENELPPEATGQPNYESYSHRLSHIGLISASHVKALVYSWTHRSADRTNTIEPNSITQIPLVKAFNLSSGAAVVRGPGFTGGDILRRTNTGTFGDIRVNIKPPFAQRYRVRIRYASTTDLQFHTSINGKAINQGNFSATMNRGEDLDYKTFRTVGFTTPFSFLDVQSTFTIGAWNFSSGNEVYIDRIEFVPVEVTYEAEYDFEKAQEKVTALFTSTNPRGLKTDVKDYHIDQVSNLVESLSDEFYLDEKRELFEIVKYAKQLHIERNM

SEQ ID NO: 213 - protein, 719 aa, Bacillus thuringiensis
MKLKNPDKHQSFSSNAKVDKISTDSLKNETDIELQNINHEDCLKISEYENVEPFVSASTIQTGISIAGKILGTLGVPFAGQVASLYSFILGELWPKGKNQWEIFMEHVEEIINQKISTYARNKALTDLKGLGDALAVYHESLESWVGNRKNTRARSVVKSQYIALELMFVQKLPSFAVSGEEVPLLPIYAQAANLHLLLLRDASIFGKEWGLSSSEISTFYNRQVERAGDYSDHCVKWYSTGLNNLRGTNAESWVRYNQFRKDMTLMVLDLVALFPSYDTLVYPIKTTSQLTREVYTDAIGTVHPNASFASTTWYNNNAPSFSTIESAVVRNPHLLDFLEQVTIYSLLSRWSNTQYMNMWGGHRLEFRTIGGMLNTSTQGSTNTSINPVTLPFTSRDVYRTESLAGLNLFLTQPVNGVPRVDFHWKFVTHPIASDNFYYPGYAGIGTQLQDSENELPPETTGQPNYESYSHRLSHIGLISASHVKALVYSWTHRSADRTNTIEPNSITQIPLVKAFNLSSGAAVVRGPGFTGGDILRRTNTGTFGDIRVNINPPFAQRYRVRIRYASTTDIQFHTSINGKAINQGNFSATMNRGEDLDYKTFRTVGFTTPFSFSDVQSTFTIGAWNFSSGNEVYIDRIEFVPVEVTYEAEYDFEKAQEKVTALFTSTNPGGLKTNVTEYHIDQVSNLVESLSNEFYLDEKRELFEIVKYAKQLHTGRNM

SEQ ID NO: 214 - protein, 719 aa, Bacillus thuringiensis
MKLKNQDKHQSFSSNAKVDKISTDSLKNETDIELQNINHEDCLKMSEYENVEPFVSASTIQTGIGIAGKILGTLGVPFAGQVASLYSFILGELWPKGKNQWEIFMEHVEEIINQKISTYARNKALTDLKGLGDALAVYHDSLESWVGNRNNTRARSVVKSQYIALELMFVQKLPSFAVSGEEVPLLPIYAQAANLHLLLLRDASIFGKEWGLSSSEISTFYNRQVERAGDYSDHCVKWYSTGLNNLRGTNAESWVRYNQFRRDMTLMVLDLVALFPSYDTQMYPIKTTAQLTREVYTDAIGTVHPHPSFTSTTWYNNNAPSFSAIEAAVVRNPHLLDFLEQVTIYSLLSRWSNTQYMNMWGGHKLEFRTIGGTLNISTQGSTNTSINPVTLPFTSRDVYRTESLAGLNLFLTHPVNGVPRVDFHWKFVTHPIASDNFYYPGYAGIGTQLQDSENELPPEATGQPNYESYSHRLSHIGLISASHVKALVYSWTHRSADRTNTIEPNSITQIPLVKAFNLSSGAAVVRGPGFTGGDILRRTNTGTFGDIRVNINPPFAQRYRVRIRYASTTDLQFHTSINGKAINQGNFSATMNRGEDLDYKTFRTVGFTTPFSFLDVQSTFTIGAWNFSSGNEVYIDRIEFVPVEVTYEAEYDFEKAQEKVTALFTSTNPRGLKTDVKDYHIDQVSNLVESLSDEFYLDEKRELFEIVKYAKQLHIERNM

SEQ ID NO: 215 - protein, 720 aa, Bacillus thuringiensis Ly30
MKLKNPDKHQSFSSNAKVDKISTDSLKNETDIELQNINHEDCLKMSEYENVEPFVSASTIQTGIGIAGKILGTLGVPFAGQVASLYSFILGELWPKGKNQWEIFMEHVEEIINQKISTYARNKALTDLKGLGDALAVYHDSLESWVGNRNNTRARSVVKSQYIALELMFVQKLPSFAVSGEEVPLLPIYAQAANLHLLLLRDASIFGKEWGLSSSEISTFYNRQVERAGDYSDHCVKWYSTGLNNLRGTNAESWVRYNQFRRDMTLMVLDLVALFPSYDTQMYPIKTTAQLTREVYTDAIGTVHPHPSFTSTTWYNNNAPSFSAIEAAVVRNPHLLDFLEQVTIYSLLSRWSNTQYMNMWGGHKLEFRTIGGTLNISTQGSTNTSINPVTLPFTSRDVYRTESLAGLNLFLTQPVNGVPRVDFHWKFVTHPIASDNFYYPGYAGIGTQLQDSENELPPEATGQPNYESYSHRLSHIGLISASHVKALVYSWTHRSADRTNTIEPNSITQIPLVKAFNLSSGAAVVRGPGFTGGDILRRTNTGTFGDIRVNINPPFAQRYRVRIRYASTTDLQFHTSINGKAINQGNFSATMNRGEDLDYKTFRTVGFTTPFSFLDVQSTFTIGAWNFSSGNEVYIDRIEFVPVEVTYEAEYDFEKAQEKVTALFTSTNPRGLKTDVKDYHIDQVSNLVESLSDEFYLDEKRELFEIVKYAKQLHIERNMP

SEQ ID NO: 216 - protein, 719 aa, Bacillus thuringiensis entomocidus BP465
MKLKNPDKHQSLSSNAKVDKIATDSLKNETDIELKNMNNEDYLRMSEHESIDPFVSASTIQTGIGIAGKILGTLGVPFAGQIASLYSFILGELWPKGKSQWEIFMEHVEEIINQKILTYARNKALSDLRGLGDALAVYHESLESWVENRNNTRARSVVKNQYIALELMFVQKLPSFAVSGEEVPLLPIYAQAANLHLLLLRDASIFGKEWGLSASEISTFYNRQVERTRDYSDHCIKWYNTGLNNLRGTNAKSWVRYNQFRKDMTLMVLDLVALFPSYDTLVYPIKTTSQLTREVYTDAIGTVHPNQAFASTTWYNNNAPSFSAIEAAVIRSPHLLDFLEKVTIYSLLSRWSNTQYMNMWGGHRLESRPIGGALNTSTQGSTNTSINPVTLQFTSRDVYRTESLAGLNLFLTQPVNGVPRVDFHWKFPTLPIASDNFYYLGYAGVGTQLQDSENELPPETTGQPNYESYSHRLSHIGLISASHVKALVYSWTHRSADRTNTIEPNSITQIPLVKAFNLSSGAAVVRGPGFTGGDILRRTNTGTFGDIRVNINPPFAQRYRVRIRYASTTDLQFHTSINGKAINQGNFSATMNRGEDLDYKTFRTIGFTTPFSFSDVQSTFTIGAWNFSSGNEVYIDRIEFVPVEVTYEAEYDFEKAQEKVTALFTSTNPRGLKTDVKDYHIDQVSNLVESLSDEFYLDEKRELFEIVKYAKQIHIERNM

SEQ ID NO: 217 - protein, 719 aa, Bacillus thuringiensis PP61
MKLKNPDKHQSLSSNAKVDKIATDSLKNETDIELKNMNNEDYLRMSEHESIDPFVRASTIQTGIGIAGKILGTLGVPFAGQIASLYSFILGELWPKGKSQWEIFMEHVEEIINQKILTYARNKAPSDLRGLGDALAVYHESLESWVENRNNTRARSVVKNQYIALELMFVQKLPSFAVSGEEVPLLPIYAQAANLHLLLLRDASIFGKEWGLSASEISTFYNRQVERTRDYSDHCIKWYNTGLNNLRGTNAKSWVRYNQFRKDMTLMVLDLVALFPSYDTLVYPIKTTSQLTREVYTDAIGTVHPNQAFASTTWYNNNAPSFSAIEAAVIRSPHLLDFLEKVTIYSLLSRWSNTQYMNMWGGHRLESRPIGGALNTSTQGSTNTSINPVTLQFTSRDVYRTESWAGLNLFLTQPVNGVPRVDFHWKFPTLPIASDNFYYLGYAGVGTQLQDSENELPPETTGQPNYESYSHRLSHIGLISASHVKALVYSWTHRSADRTNTIEPNSITQIPLVKAFNLSSGAAVVRGPGFTGGDILRRTNTGTFGDIRVNINPPFAQRYRVRIRYASTTDLQFHTSINGKAINQGKFSATMNRGEDLDYKTFRTVGFTTPFGFSDVQSTFTIGAWNFSSGNEVYIDRIEFVPVEVTYEAEYDFEKAQEKVTALFTSTNPRGLKTDVKDYHIDQVSNLVESLSDEFYLDEKRELFEIVKYAKQIHIERNM

SEQ ID NO: 218 - protein, 719 aa, Bacillus thuringiensis GS8
MKLKNQDKHQSLSSNAKVDKIATDSLKNETDIELKNMNNEDYLRMSEHESIDPFVSASTIQTGIGIAGKILGTLGVPFAGQIASLYSFILGELWPKGKSQWEIFMEHVEEIINQKILTYARNKALSDLRGLGDALAVYHESLESWVENRNNTRARSVVKNQYIALELMFVQKLPSFAVSGEEVPLLPIYAQAANLHLLLLRDASIFGKEWGLSASEISTFYNRQVERTRDYSDHCIKWYNTGLNNLRGTNAKSWVRYNQFRKDMTLMVLDLVALFPSYDTLVYPIKTTSQLTREVYTDAIGTVHPNQAFASTTWYNNNAPSFSAIEAAVIRSPHLLDFLEKVTIYSLLSRWSNTQYMNMWGGHRLESRPIGGALNTSTQGSTNTSINPVTLQFTSRDVYRTESWAGLNLFLTQPVNGVPRVDFHWKFPTLPIASDNFYYLGYAGVGTQLQDSENELPPETTGQPNYESYSHRLSHIGLISASHVKALVYSWTHRSADRTNTIEPNSITQIPLVKAFNLSSGAAVVRGPGFTGGDILRRTNTGTFGDIRVNINPPFAQRYRVRIRYASTTDLQFHTSINGKAINQGNFSATMNRGEDLDYKTFRTVGFTTPFSFSDVQSTFTIGAWNFSSGNEVYIDRIEFVPVEVTYEAEYDFEKAQEKVTALFTSTNPRGLKTDVKDYHIDQVSNLVESLSDEFYLDEKRELFEIVKYAKQIHIERNM

SEQ ID NO: 219 - protein, 719 aa, Bacillus thuringiensis BF-4
MKLKNPDKHQSLSSNAKVDKIATDSLKNETDIELKNINHEDFLRMSEHESIDPFVSASTIQTGIGIAGKILGTLGVPFAGQIASLYSFILGELWPKGKSQWEIFMEHVEELIDQKISTYARNIALADLKGLGDALAVYHESLESWIKNRNNARARSVVKNQYIALELMFVQKLPSFAVSGEEVPLLPIYAQAANLHLLLLRDASIFGKEWGLSASEISTFYNRQVERTRDYSDHCIKWYNTGLNNLRGTNAKSWVRYNQFRKDMTLMVLDLVALFPSYDTLVYPIKTTSQLTREVYTDAIGTVHPNQAFASTTWYNNNAPSFSAIEAAVIRSPHLLDFLEKVTIYSLLSRWSNTQYMNMWGGHRLESRPIGGALNTSTQGSTNTSINPVTLQFTSRDVYRTESWAGLNLFLTQPVNGVPRVDFHWKFPTLPIASDNFYYLGYAGVGTQLQDSENELPPETTGQPNYESYSHRLSHIGLISASHVKALVYSWTHRSADRTNTIEPNSITQIPLVKAFNLSSGAAVVRGPGFTGGDILRRTNTGTFGDIRVNINPPFAQRYRVRIRYASTTDLQFHTSINGKAINQGNFSATMNRGEDLDYKTFRTVGFTTPFSFSDVQSTFTIGAWNFSSGNEVYIDRIEFVPVEVTYEAEYDFEKAQEKVTALFTSTNPRGLKTDVKDYHIDQVSNLVESLSDEFYLDEKRELFEIVKYAKQIHIERNM

SEQ ID NO: 220 - protein, 702 aa, Bacillus thuringiensis LB52
MKLKNPDKHQSLSSNAKVDKIATDSLKNETDIELKNMNNEDYLRMSEHESIDPFVSASTIQTGIGIAGKILGTLGVPFAGQIASLYSFILGELWPKGKSQWEIFMEHVEEIINQKILTYARNKALSDLRGLGDALAVYHESLESWVKNRNNTRARSVVKNQYIALELMFVQKLPSFAVSGEEVPLLPIYAQAANLHLLLLRDASIFGKEWGLSASEISTFYNRQVERTRDYSDHCVKWYNTGLNNLRGTNAKSWVRYNQFRKDMTLMVLDLVALFPSYDTLVYPIKTTSQLTREVYTDAIGTVHPNQAFASTTWYNNNAPSFSAIEAAVIRSPHLLDFLEKVTIYSLLSRWSNTQYMNMWGGHRLESRPIGGALNTSTQGSTNTSINPVTLQFTSRDVYRTESWAGLNLFLTQPVNGVPRVDFHWKFPTLPIASDNFYYLGYAGVGTQLQDSENELPPETTGQPNYESYSHRLSHIGLISASHVKALVYSWTHRSADRTNTIEPNSITQIPLVKAFNLPSGAAVVRGPGFTGGDILRRTNTGTFGDIRVNINPPFAQRYRVRIRYASTTDVQFHTSINGKAINQGNFSATMNRGEDLDYKTFRTVGFTTPFSLSDVQSTFTIGAWNFSSGNEVYIDRIEFVPVEVTYEAEHDFEKAQEEVTALFTSTNPGGLKTNVTEYHIDQVSNLVESLSMNSISMKREN

SEQ ID NO: 221 - protein, 719 aa, Bacillus thuringiensis C18
MKLKNPDKHQTLSSNAKVDKIATDSLKNETDIELKNMNNEDYLRMSEHESIDPFVSASTIQTGIGIAGKILGTLGVPFPGQIASLYSFILGELWPKGKSQWEIFMEHVEAIINRKISTYARNKALTDLKGLGDALAVYHESLESWVGNRNNTRARSVVKNQYIALELMFVQKLPSFAVSGEEVPLLPIYAQAANLHLLLLRDASIFEKNGGLSASEISTFYNRQVERTRDYSYHCVKWNNTGLNNLRATNGQSWVRYNQFRKDIELMVLDLVRVFPSYDTLVYPIKTTSQLTREVYTDAIGTVDPNQALRSTTWYNNNAPSFSAIEAAVIRSPHLLDFLEKVTIYSLLSRWSNTQYMNMWGGHRLESRPIGGALNTSTQGSTNTSINPVTLQFTSRDFYRTESWAGLNLFLTQPVNGVPRVDFHWKFPTLPIASDNFYYLGYAGVGTQLQDSENELPPETTGQPNYESYSHRLSHIGLISGSHVKALVYSWTHRSADRTNTIEPNSITQIPLVKAFNLSSGAAVVRGPGFTGGHILRRTKSGTFGHIRVNINPPFAQRYRVRMSYASTTDLQFHTSINGKAINQGNFSATMNRGEDLDYKTFRTVGFTTPFSFSDVQSTFTIGAWNFSSGNEVYIGRIEFVPVEVTYEAEYDFEKAQEKVTALFTSTNPRGLKTDVKDYHIDQVSNLVESLSDELYLDEKRELFEIVKYAKQIHIERNM

SEQ ID NO: 222 - protein, 719 aa, Bacillus thuringiensis
MKSKNQNMYRSFSSNATVDKSFTDPLEHNTNMELQNSNHEDCLKMSEYESVEPFVSVSTIQTGIGIAGKILGNLGVPFAGQVASLYSFILGELWPKGKSQWEIFMEHVEELINQKISTYARNKALADLKGLGDALAVYHESLESWIENRNNTRVRSVVKNQYIALELMFVQKLPSFAVSGEEVPLLPIYAQAANLHLLLLRDASIFGKEWGLSESEISTFYNRQSSQTQEYSDYCSEWYNTGLNRLRGTNAESWVRYNQFRRDMTLMVLDLVALFPSYDTRMYPIPTSAQLTREVYTDAIGTVHPNASFASTTWYNNNAPSFSTIEAAVVRNPHLLDFLEQVTIYSLLSRWSNTQYMNMWGGHKLEFRTIGGTLNTSTQGSTNTSINPVTLPFTSRDVYRTESLAGLNLFLTQPVNGVPRVDFHWKFVTHPIASDNFYYPGYAGIGTQLQDSENELPPETTGQPNYESYSHRLSHIGLISASHVKALVYSWTHRSADRTNTINSDSITQIPLVKAFNLPSGASVVRGPGFTGGDILQRTNTGTFGDIRVNINPPFAQRYRLRIRYASTTNLEFHTSINGKAINQGNFSATMNRGEDLDYKAFRTVGFTTPFSFSNAQSTFTIGAWNFSLGNEVYIDRIEFVPVEVTYEAEYDLKKAQDEITAMFTSTNLRRLKTNVTDCHIDQVSNLVESLSDEFYLDEKRELFEIVKYAKQLNIERNM

SEQ ID NO: 223 - protein, 719 aa, Bacillus thuringiensis BTC007
MKLKNPDKHQSLSSNAKVDKIATDSLKNETDIELKNINHEDFLRMSEHESIDPFVSASTIQTGIGIAGKILGTLGVPFAGQIASLYSFILGELWPKGKSQWEIFMEHVEELIDQKISTYARNIALADLKGLGDALAVYHESLESWIKNRNNARATSVVKSQYIALELLFVQKLPSFAVSGEEVPLLPIYAQAANLHLLLLRDASVFGKEWGLSNSQISTFYNRQVERTSDYSDHCVKWYSTGLNNLRGTNAESWVRYNQFRKDMTLMVLDLIALFPSYDTLVYPIKTTSQLTREVYTDAIGTVHPNASFASTTWYNNNAPSFSAIESAVVRNPHLLDFLEQVTIYSLLSRWSNTQYMNMWGGHRLEFRTIGGVLNTSTQGSTNTSINPVTLPFTSRDVYRTESLAGLNLFLTQPVNGVPRVDFHWKFATLPIASDNFYYLGYAGVGTQLQDSENELPPETTGQPNYESYSHRLSHIGLISASHVKALVYSWTHRSADRTNTIEPNSITQIPLVKAFNLSSGAAVVRGPGFTGGDILRRTNTGTFGDIRVNINPPFAQRYRVRIRYASTTDLQFHTSINGKAINQGNFSATMNRGEDLDYKTFRTVGFTTPFSFSDVQSTFTIGAWNFSSGNEVYIDRIEFVPVEVTYEAEYDFEKAQEKVTALFTSTNPRGLKTDVKDYHIDQVSNLVESLSDEFYLDEKRELFEIVKYAKQIHIERNM

SEQ ID NO: 224 - protein, 710 aa, Bacillus thuringiensis
  SITE 200: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
MKSKNQNMHQSLSNNATVDKNFTGSLENNTNTELQNFNHEGIEPFVSVSTIQTGIGIAGKILGNLGVPFAGQVASLYSFILGELWPKGKSQWEIFMEHVEELINQKISTYARNKALADLKGLGDALAVYHESLESWIENRNNTRTRSVVKSQYITLELMFVQSLPSFAVSGEEVPLLPIYAQAANLHLLLLRDASIFGKXWGLSDSEISTFYNRQSGKSKEYSDHCVKWYNTGLNRLMGNNAESWVRYNQFRRDMTLMVLDLVALFPSYDTQMYPIKTTAQLTREVYTDAIGTVHPHPSFTSTTWYNNNAPSFSTIEAAVVRNPHLLDFLEQVTIYSLLSRWSNTQYMNMWGGHKLEFRTIGGTLNTSTQGSTNTSINPVTLPFTSRDVYRTESLAGLNLFLTQPVNGVPRVDFHWKFVTHPIASDNFYYPGYAGIGTQLQDSENELPPEATGQPNYESYSHRLSHIGLISASHVKALVYSWTHRSADRTNTIEPNSITQIPLVKAFNLSSGAAVVRGPGFTGGDILRRKNTGTFGDIRVNINPPFAQRYRVRIRYASTTDLQFHTSINGKAINQGNFSATMNRGEDLDYKTFRTVGFTTPFSFSDVQSTFTIGAWNFSSGNEVYIDRIEFVPVEVTYEAEYDFEKAQEEVTALFTSTNPRGLKTDVKDYHIDQVSNLVESLSDKFYLDEKRELFEIVKYAKQLHIERNM

SEQ ID NO: 225 - protein, 381 aa, Bacillus thuringiensis ly4a3
RDVIVIVLDLVALFPSYDTQMYPIKTTAQLTREVYTDAIGTVHPHPSFTSTTWYNNNAPSFSAIEAAVVRNPHLLDFLEQVTIYSLLSRWSNTQYMNMWGGHKLEFRTIGGTLNISTQGSTNTSINPVTLPFTSRDVYRTESLAGLNLFLTQPVNGVPRVDFHWKFVTHPIASDNFYYPGYAGIGTQLQDSENELPPEATGQPNYESYSHRLSHIGLISASHVKALVYSWTHRSADRTNTIEPNSITQIPLVKAFNLSSGAAVVRGPGFTGGDILRRTNTGTFGDIRVNINPPFAQRYRVRIRYASTTDLQFHTSINGKAINQGNFSATMNRGEDLDYKTFRTVGFTTPFSFLDVQSTFTIGAWNFSSGNEVYIDKIEFIP

SEQ ID NO: 226 - protein, 1167 aa, Bacillus thuringiensis EG5847
MEINNQKQCIPYNCLSNPEEVLLDGERILPDIDPLEVSLSLLQFLLNNFVPGGGFISGLVDKIWGALRPSEWDLFLAQIERLIDQRIEATVRAKAITELEGLGRNYQIYAEAFKEWESDPDNEAAKSRVIDRFRILDGLIEANIPSFRIIGFEVPLLSVYVQAANLHLALLRDSVIFGERWGLTTKNVNDIYNRQIREIHEYSNHCVDTYNTELERLGFRSIAQWRIYNQFRRELTLTVLDIVALFPNYDSRLYPIQTFSQLTREIVTSPVSEFYYGVINSGNIIGTLTEQQIRRPHLMDFFNSMIMYTSDNRREHYWSGLEMTAYFTGFAGAQVSFPLVGTRGESAPPLTVRSVNDGIYRILSAPFYSAPFLGTIVLGSRGEKFDFALNNISPPPSTIYRHPGTVDSLVSIPPQDNSVPPHRGSSHRLSHVTMRASSPIFHWTHRSATTTNTINPNAIIQIPLVKAFNLHSGATVVRGPGFTGGDILRRTNTGTFADMRVNITGPLSQRYRVRIRYASTTDLQFFTRINGTSVNQGNFQRTMNRGDNLESGNFRTAGFSTPFSFSNAQSTFTLGTQAFSNQEVYIDRIEFVPAEVTFEAESDLERAQKAVNALFTSTNQLGLKTDVTDYQIDQVSNLVECLSDEFCLDEKRELSEKVKHAKRLSDKRNLLQDPNFTSINRQLDRGWRGSTDITIQGGNDVFKENYVTLPGTFDECYPTYLYQKIDESKLKAYTRYELRGYIEDSQDLEVYLIRYNAKHETVNVPGTGSLWPLSVESPIGRCGEPNRCVPHIEWNPDLDCSCRDGEKCAHHSHHFSLDIDVGCTDLNEDLGVWVIFKIKTQDGHARLGNLEFLEEKPLLGEALARVKRAEKKWRDKREQLQFETNIVYKEAKESVDALFVDSHYNRLQADTNITMIHAADKRVHRIREAYLPELSVIPGVNADIFEELEGLIFTAFSLYDARNIIKNGDFNNGLSCWNVKGHVDIQQNDHRSVLVVPEWESEVSQEVRVCPGRGYILRVTAYKEGYGEGCVTIHEIEDNTDELKFSNCIEEEVYPTDTGNDYTAHQGTTGCADACNSRNVGYEDGYEINTTASVNYKPTYEEEMYTDVRRDNHCEYDRGYGNHTPLPAGYVTKELEYFPETDTVWIEIGETEGTFIVDSVELLLMEE

SEQ ID NO: 227 - protein, 1168 aa, Bacillus thuringiensis
MEINNQNQCIPYNCLSNPEEVFLDGERILPDIDPLEVSLSLLQFLLNNFVPGGGFISGLLDKIWGALRPSDWELFLAQIEQLIDRRIERTVRAKAIAELEGLGRSYQLYGEAFKEWEKTPDNTAARSRVTERFRIIDAQIEANIPSFRVSGFEVPLLLVYTQAANLHLALLRDSVVFGERWGLTTTNVNDIYNRQVNRIGEYSKHCVDTYKTELERLGFRSIAQWRIYNQFRRELTLTVLDIVAVFPNYDSRLYPIRTISQLTREIYTSPVSEFYYGVINSNNIIGTLTEQQIRRPHLMDFFNSMIMYTSDNRREHYWSGLEMTATNTEGHQRSFPLAGTIGNSAPPVTVRNNGEGIYRILSEPFYSAPFLGTSVLGSRGEEFAFASNTTTSLPSTIYRNRGTVDSLVSIPPQDYSVPPHRGYSHLLSHVTMRNSSPIFHWTHRSATPRNTIDPDSITQIPAVKGAYIFNSPVITGPGHTGGDIIRFNPNTQNNIRIPFQSNAVQRYRIRMRYAAEADCILESGVNIVTGAGVTFRPIPIKATMTPGSPLTYYSFQYADLNINLTAPIRPNNFVSIRRSNQPGNLYIDRIEFIPIDPIREAEHDLERAQKAVNALFTSSNQLGLKTDVTDYHIDQVSNLVACLSDEFCLDEKRELSEKVKHAKRLSDERNLLQDQNFTGINRQVDRGWRGSTDITIQGGNDVFKENYVTLPGTFDECYPTYLYQKIDESKLKPYTRYELRGYIEDSQDLEVYLIRYNAKHETLNVPGTGSLWPLAAESSIGRCGEPNRCAPHIEWNPELDCSCRDGEKCAHHSHHFSLDIDVGCTDLNEDLGVWVIFKIKTQDGYARLGNLEFLEEKPLLGEALARVKRAEKKWRDKRDKLEWETNIVYKEAKESVDALFVDSQYNRLQTDTNIAMIHVADKRVHRIREAYLPELSVIPGVNAAIFEELEGLIFTAFSLYDARNVIKNGDFNHGLSCWNVKGHVDVEEQNNHRSVLVVPEWEAEVSQEVRVCPGRGYILRVTAYKEGYGEGCVTIHEIEDHTDELKFRNCEEEEVYPNNTVTCNDYPANQEEYRAAETSRNRGYGESYESNSSIPAEYAPIYEKAYTDGRKENSCESNRGYGNYTPLPAGYVTKELEYFPETDKVWIEIGETEGTFIVDSVELLLMEE

SEQ ID NO: 228 - protein, 1168 aa, Bacillus thuringiensis
MEINNQNQCIPYNCLSKPEEVFLDGERILPDIDPLEVSLSLLQFLLNNFVPGGGFISGLIDKIWGALRPSEWELFLAQIEQLIDRRIEATVRAKAIAELEGLGRSYQLYGEAFKEWEKTPDNTAARSRVTERFRIIDAQIEANIPSFRVSGFEVPLLSVYTQAANLHLALLRDSVIFGERWGLSTTNVNDIYNRQVKRIHEYSDHCVDTYKTELERLEFRSIAQWRIYNQFRRELTLTVLDIVALFPNYDGRLYPIRTISQLTREIYTSPVSEFYYGPIYNHNMIGTFIERQLRRPHLMDFFNSMTMYTSDNRREYYWSGLEMTATLTSGNQVSFPLAGTRGNSAPPVSVRKTGEGIYRILSEPFYSAPFLGTSVLGSRGEEFAFASNTTTSLPSTIYRNRGTVDSLVSIPPQDYSVPPHRGYSHLLSHVTMHNSSPIFHWTHRSATPRNIIYPDSITQIPVVKASHLSGGSVIKGPGHTGGDLISLPVNNFTHFRIPFQANTPQRYRIRICYAADSDGTLDSGVFLSAAAGDGFNTTSYRATMSPEGSLTSRDFQFLDLNTSFTSDVASNLWLHFIRYIRPGNLYIDRAEFIPVDATFEAGYNLERAQKAVNALFTSTNQKGLQTDVTDYHIDQVSNLVDCLSDEFCLDEKRKLSEKVKQAKRLSDERNLLQDSNFRGINREQDRGWRGSTDITIQGGNDVFKENYVTLPGTFDACYPTYLYQKVDESKLKAYTRYQLRGYIEDSQDLEVYLIRYNAKYETLNVPGMGSLWPLSVESPIGKCGEPNRCVPQLEWNPDFDCSCRDGEKCAHHSHHFSLDIDVGCTDLNENLGIWVIFKIKTQDGHARLGNLEFLEEKPLLGEALARVKRAEKKWRDKREILQSETNIVYKEAKEAVDGLFVDSQYERLQSDTNIAMIHAADKRVHRIREAYLPELSVIPGVNAAIFEELEGRIFTAYSLYDARNVIKNGDFNNGLSCWNVKGHVDIKQNGHRSVLVIPEWEAQVSQEVRVCPGRGYILRVTANKEGYGEGCVTIHEIENHTEKLKFRNCEEEEVYPNNTGTCNDYTAHQQGTAGCADACNTRNVGYEDAYEMNTTTSVNYKPTYEEEVYTDGRRDNPCEMERGYTPLPVGYVTKELEYFPETNTVWIEIGETEGKFIVDSVELLLMEE

SEQ ID NO: 229 - protein, 1215 aa, Bacillus thuringiensis morrisoni BF190
MNSNRKNENEIINALSIPAVSNHSAQMDLSPDARIEDSLCVAEGNNIDPFVSASTVQTGISIAGRILGVLGVPFAGQLASFYSFLVGELWPSGRDPWEIFMEHVEQIVRQQQITDSVRDTAIARLEGLGRGYRSYQQALETWLDNRNDARSRSIIRERYIALELDITTAIPLFSIRNEEVPLLMVYAQAANLHLLLLRDASLFGSEWGMSSADVNQYYQEQIRYTEEYSNHCVQWYNTGLNRLRGTTAETWVRYNQFRRDLTLGVLDLVALFPSYDTRTYPIPTTAQLTREVYTDPNGVVAGPNNSWFRNGASFSAIENAIIRQPHLYDFLTNLTIYTRRSQVGTTIMNLWAGHRITFNRIQGGSTSEMVYGAITNPVSVSDIPFVNRDVYRTVSLAGGLGSLSGIRYGLTRVDFDMIFRNHPDIVTGLFYHPGHAGIATQVKDSDTELPPETTEQPNYRAFSHLLSHISMGPTTQDVPPVYSWTHQSADRTNTINSDRITQIPLVKAHTLQSGTTVVKGPGFTGGDILRRTSGGPFAFSNVNLDFNLSQRYRARIRYASTTNLRIYVTVAGERIFAGQFDKTMDAGAPLTFQSFSYATINTAFTFPERSSSLTIGADTFSSGNEVYVDRFELIQVTATFEAESDLERARKAVNALFTSTNPRGLKTDVTDYHIDQVSNLVECLSDEFCLDKKRELLEEVKYAKRLSDERNLLQDPTFTSISGQTDRGWIGSTGISIQGGDDIFKENYVRLPGTVDECYPTYLYQKIDESQLKSYTRYQLRGYIEDSQDLEIYLIRYNAKHETLSVPGTESPWPSSGVYPSGRCGEPNRCAPRIEWNPDLDCSCRYGEKCVHHSHHFSLDIDVGCTDLNEDLGVWVIFKIKTQDGHAKLGNLEFIEEKPLLGKALSRVKRAEKKWRDKYEKLQLETKRVYTEAKESVDALFVDSQYDKLQANTNIGIIHGADKQVHRIREPYLSELPVIPSINAAIFEELEGHIFKAYSLYDARNVIKNGDFNNGLSCWNVKGHVDVQQNHHRSVLVLSEWEAEVSQKVRVCPDRGYILRVTAYKEGYGEGCVTIHEFEDNTDVLKFRNFVEEEVYPNNTVTCNDYTTNQSAEGSTDACNSYNRGYEDGYENRYEPNPSAPVNYTPTYEEGMYTDTQGYNHCVSDRGYRNHTPLPAGYVTLELEYFPETEQVWIEIGETEGTFIVGSVELLLMEE

SEQ ID NO: 230 - protein, 1170 aa, Bacillus thuringiensis kurstaki K1
MDNNPKIQECIPYNCLNNPESEILDIEGLSTRSREQVAEISLGLTRFLLENLFPGATFGFGLFDIIWGIFGPDQWSMFLEQIEQLIDQRIETVERNRAIQTLIGLSNSYDVNIEALKEWENNPDNSASQERVRNRFRTTDDALITSIPLLAIPNFEIATLSVYVQAANLHLSLLRVAVFFGERWGLTQINVDDLYRRLTNNIRKYSDHCARWYNEGLDNISGLSRSINFQREVTISVLDIVALFPNYDIRTYPISTTSQLTREIFTSPIVVPNDFSVAYEGVRRAPHLFDFLEKLVIYTGDRSGIRHWAGHEITSRRTDSYHGIIRYPLYGTAANAESPYTLALQPSESIYRTLSEPIFSQTGGLSPHRRRVVEGVEFSIVNNNVNPSSFVYRRKGSLDSFTELPPEDESVPPYIGISHQLCHVGFGRTNVIFEPSNFARVPVFSWTHRSATPTNTIDPDRITQIPSVKASSLRNSTVVSGPGFTGGDIVRMGAVHQIYATDLSMNVRPSVALSRYLIRLRYACRGSSNIVIHGPSIRFVSLPSTMSNDEPLTYQSFRYASITTPITRPIYNMFNLSISRISGVQNLFIDRIEFIPVDANFEAERDLERAQKAVNALFTSTNQRGLKIDVTDYHIDQVSNLVDCLSDEFCLDEKRELSEKVKHAKRLSDERNLLQDLNFKDINRQPERGWSGSTGITIQGGDDVFKENYVTLPGTFDECYPTYLYQKIDESKLKAYTRYQLRGYIEDSQDLEIYLIRYNAKHETVNVPGSGSLWPLSVESSVGKCGEPNRCASRMEWNPDLDCSCRDGEKCAHHSHHFSLDIDVGCTDLNEDLGVWVIFKIKTQDGHAKIGNLEFLKEKLLLGEALARVKKAEKKWRDKRDKLEWETNVVYKEAKESVDALFVDSQYSRLQADTNIAMIHAADKRVHRIREAYLPELTVIPGVNASIFEELEGRIFTAYSLYGARNVIKNGDFNNGLSCWNVKGHVEVQQIHHRSVLVVPSWKTEVSQEVCVCPGRGYILRVTAYKEGYGEGNVTIHEIENNTDELKFRNCEEEEVYPNNTVTCNDYTVNQEEYKGTCTSRNRGYDESYESSSSESAYYASVYEEKGYTDGRRENLCEFNRGYGDYTSLPTAYVTKELEYFPETDKVWIEIGETEGAFILDSVELLLMEE

SEQ ID NO: 231 - protein, 699 aa, Bacillus thuringiensis LBIT 1189
MKPNNQNNHQTLLSNVTVDKPFADALKNETTMELKNSNHEDCLKMSEHESIEPFVSASTIQTGIGIAGKILGSLGVPFAGQVASLYSFILGELWPKGKSQWEIFMEHVEELVAQKISTYARNKALSDLKGLGDALAVYHESLESWIENRNNTRARSVVKNQYIALELMFVQNLPSFAVSGEEVPLLPIYRQAANLHLLLLRDASTFGKEWGLSTSEISTFYNRQSNRTIEYSDYCSKWYNTGLNRLRGTNAESWVRYNQFRRDMTLMVLDLVALFPSYDTHMYPIKTSAQLTREVYTDLNGVVAGPNNSWFKNGASFSAIENAIIRKPHLYDFITNLTIYTRISRANPSYMNLWAGHRITFNRIGSSNSSELVYGAITNPVSTSSLSFVNEDIYRTTSLAGALGTLSGLIYGLTKADFDTRFRNHTNIASGKTYFPGHSGIGTQVRNSETELPPETTEQPSYRAFSHLLSHISMSPTTAATPPVYSWTHQSADRTNTINSDSITQIPLVKANNLHPGAIVVKGPGFTGGDILRRTSTGTFVDLPVNLINWQLSQRYRVRIRYASTTDLQFHTSINGRAINQGNFSATMNRGDALESRTFRTAGFTTPFNFSDAQSTFTISAWNFSSGNEVYIDQIEFIPTEVTFEAEYDSEKAQKAVNDLFTPTNPRGLKADVTDYHIDQVSNLVECLFDEDCHNEKRE

SEQ ID NO: 232 - protein, 753 aa, Bacillus thuringiensis fukuokaensis
MNPYQNNDEIVDVPENYDNNLNRYPYANDPNVAMQNTNYKDWMNGYEEINPSSITAILASIGILNRVIALTGVLGNTQEVISIIQDALGFIRNGTGNELLIHVEQLIQQTLATQYRSAATGAIYGISRSYDNYLMFFRQWERNRTRENGQQVESAFTTINTLCINALAPQASLSRRGFETLLLPNYAMAANFHLLLLRDAVLYRNQWLSNSISTANVNLNILRAAINEYITHCTRWYQDGLNRFDRSSRANMNEWRRFNAYRRDMTLSVLDFATVFPTYDPVLFPAATNVELTRVVYTDPIVMAGGRTAIPGFTRMENLVNSASRVSFLNQMNIYTSFYFRPHNIPRYYWSGNQNFLSNGTSNLYGYRSDGRTTFNVSNIDIFRVNMTTHIGGAFTDDYRGLHRAEFIGANTQNNQRTSLLYSVEIPSSHFRFENHTVFLPGESGLEPNERNYTHRLFQMMNEVSVNPNARGRVFLHAWTHRSLRRTNGLRSDQILQIPAVKTISNGGDRAVVLNYGENIMKLDNLTTGLSYKLTAVDSEASNTRFIVRVRYASMNNNKLNLVLNGAQIASLNVEHTVQRGGSLTDLQYGNFKYATFAGNFKMGSQSILGIFKEIPNIDFVLDKIELIPSNFMSSLEQTQNYNTYNQDTIYTHNQGYDTYDQNSSGMYHQSYNNYDQNMDTTYQPSYDNYNQNASGTYDDGYNPNASDSYDQSYTNNYSQNTNSMYDQGYYNNNYDQHSGCTCNQGYDNNYLK

SEQ ID NO: 233 - protein, 765 aa, Bacillus thuringiensis higo LBIT-976
MNPYQNKNEYEIVNNPQNYNTVSNRYPYTNDPNVAIQNTNYKDWMNGYEEINPSLISLILASIGILNQAIALTGVLGKTPENINIVQEMVGLISGSTGNDLLVHTEQLIQQTLAQQYRNAATGAVNAISKSYNDYLMFFRQWERNRTSQNGLLVESAFNSVNTLCLRTLTPQEALSRRGFETLLLPNYAQAANFHLLLLRDAVLYRTQWLPNFISTTNANIEILERSINQYRNHCNHWYNDGLNRFARTSFDDWVRFNAYRRDMTLSVLDFVTVFPTYNPINFPTPTNVELTRIVYTDPISPPRGYARTGSPSFRQMEDLIISGSPSFLNQLSIFTTYYHDPRNVNRDFWAGNRNYLSNGTSRQSGATTPWRTNIPMQNIDIFRVNLTTHDIDDISRSYGGVHRSDFIGVNTINNQRTTLFYHQNVDTSRFLIRNETVFLPGDSGLAPNERNYTHRLFQVMTTYRTNPNARRAAFLHAWTHRSLRRRNGFRTDQIMQIPAVKSISNGGDRAVISYTGENMMKLDNLTASLSYKLTAEDSEASNTRFIVRIRYASMNNNRLNLILNGTQIASLNVEGTMQNGGSLTNLQSENFKYATFSGNFKMGSQSIVGIFKEISNADFIFDQIEFIPIHFMPLLEQKQSYNNYDQNMDTTYQPNYDTYNQNANGMYDDTYYPNNNDSYNQNNTDMYDSGYNNNQNTNYNYDQEYNTYNQNMENTYDQSYENYNPETNNYNQYPNDMYNQEYTNDYNQNSGCRCNQGYNNNYPK

SEQ ID NO: 234 - protein, 1286 aa, Bacillus thuringiensis roskildiensis
MADLTELYPSYHNVLARPIRLDSIFDPFIDIFNALKGGWEEFAKTGYKDPLEQHLKIAWNASQNGTIDYLALTKASISFIGLIPDADAVVPFINMFVDFIFPKLFGEGSQQNSQAQFFELIIEKVKEIVDQEFRNFTLNTLLNDLDGMQTTLEHFQNDVQIAICQGEQPGLILDEKHPPCTPTKNHLVSVKESFKNARTSIETVLPHFKNPMTNNKTPDFNSDTVLLTLPMYTTAATLNLILHQGYIQFVERWKSVDYDEAFINQTKADLQHRIQEYSTTVSTTFEKFKPTLSNKKSSINTYNKYVRSMTLNCLDIAATWPTLDNVNYPSNVEIQLDQTRLVFSNLVGPFEGNDDISTYTRRSIMNYSKGDTPGDVNSAIQSLRYPRLELSKVQFYTHDQRSNGVRHCYTSGFNLTFNDNSSMSAKQDESATADSPPLTAPIKNMNANSQNSQYYDYSSINIDNQGGGGCSAFPSYQSNNPILPNQKINVFYPYGSSAHPIDPHTTDPDTWFKLGYVSSHIPYDLTPQNVIGEIDQDTKQPSLILKGFPAEKGYGGSIEYVSEPLNGANAAKLTLNQILYMQVTNLTTQKYQIRLRYATKNDTTASVWFHIIGPNNQDIINHSPDIPPRSNNKMFVQGENGKYVLDTLVDSIELPSGQLTILIQNINPDQDLFLDRIEFVPIPTLPTNPNISIPKTDTSPKDSKVLWEASPDIPIANTITLTGSVYDFADITFELYKNGNMVTSYPIKGPGPIPHRSHGNYVSCSQGILSYNYENKPVLDGFDQLRININSDPSFYDSNSGCDTKNQYSAEIKINPNLSATTDLEKITNQVNQLFTSSSQTELANTITDYRIDQIVMKVDALSNNVFGVEKKALRKLVNQAKQLSKARNVLAGGNFEKGHEWVLGREATMIANHELFKGDHLLLPPPTLYPSYAYQKIDESKLKSNTRYTVSGFIAQSEHLEVIVSRYGKEVHDMLDVPYEEALPISSDESPNCCKPATCQCPSCDGSQPDSHFFSYSIDVGSVQSDVNLGIEFGLRIAKPNGFAKISNLEIKEDRPLTDQEIKKIQRKEQKWKKAFDQEQAEVAATFQPTLDQINALYQNEDWNGSLHPHVTYQHLSAVVLPTLPKQRHWFMEDREGEHYGVTQQFQQALDRGFQQIEEQNLIHNGSFANGLTDWTVTGDAQLTIFDEDPVLELAHWDASVSQTIEIMDFEEETEYKLRVRGKGKGTVTVQHGEEELETMTFNTTSFTTQEQTFYFEGDTVDVHVQSENNTFLVDSVELIEVVEE

SEQ ID NO: 235 - protein, 722 aa, Bacillus thuringiensis
MKEQNLNKYDEITVQAASDYIDIRPIFQTNGSATFNSNTNITTLTQAINSQAGAIAGKTALDMRHDFTFRADIFLGTKSNGADGIAIAFHRGSIGFVGTKGGGLGILGAPKGIGFELDTYANAPEDEVGDSFGHGAMKGSFPSFPNGYPHAGFVSTDKNSRWLSALAQMQRIAAPNGRWRRLEIRWDARNKELTANLQDLTFNDITVGEKPRTPRTATWRLVNPAFELDQKYTFVIGSATGASNNLHQIGIIEFDAYFTKPTIEANNVNVPVGATFNPKTYPGINLRATDEIDGDLTSKIIVKANNVNTSKTGVYYVTYYVENSYGESDEKTIEVTVFSNPTIIASDVEIEKGESFNPLTDSRVGLSAQDSLGNDITQNVKVKSSNVDTSKPGEYEVVFEVTDSFGGKAEKDFKVTVLGQPSIEANNVELEIDDSLDPLTDAKVGLRAKDSLGNDITKDIKVKFNNVDTSNSGKYEVIFEVTDRFGKKAEKSIEVLVLGEPSIEANDVEVNKGETFEPLTDSRVGLRAKDSLGNDITKDVKIKSSNVDTSKPGEYEVVFEVTDRFGKYVEKTIGVIVPVIDDEWEDGNVNGWFYAGQDIKLLKDPDKKAYKGDYVFYDSRHVAISKTIPLTDLQINTNYEITVYAKAESGDHHLKVTYKKDPAGPEEPPVFNRLISTGTLVEKDYRELKGTFRVTELNKAPLIIVENFGAGYIGGIRIVKIS

SEQ ID NO: 236 - protein, 722 aa, Bacillus thuringiensis FZ-4
MKEQNLNKYDEITVQAASDYIDIRPIFQTNGSATFNSNTNITTLTQAINSQAGAIAGKTALDMRHDFTFRADIFLGTKSNGADGIAIAFHRGSIGFVGTKGGGLGILGAPKGIGFELDTYANAPEDEVGDSFGHGAMKGSFPSFPNGYPHAGFVSTDKNSRWLSALAQMQRIAAPNGRWRRLEIRWDARNKELTANLQDLTFNDITVGEKPRTPRTATWRLVNPAFELDQKYTFVIGSATGASNNLHQIGIIEFDAYFTKPTIEANNVNVPVGATFNPKTYPGINLRATDEIDGDLTSKIIVKANNVNTSKTGVYYVTYYVENSYGESDEKTIEVTVFSNPTIIASDVEIEKGESFNPLTDSRVGLSAQDSLGNDITQNVKVKSSNVDTSKPGEYEVVFEVTDSFGGKAEKDIKVTVLGQPSIEANNVELEIDDLFDPLTDAKVGLRAKDSLGNDITKDVKVKFNNVDTSNSGKYEVIFEVTDRFGKKAEKSIEVLVLGEPSIEANDVEVNKGETFEPLTDSRVGLRAKDSLGNDITKDVKIKSSNVDTSKPGEYEVVFEVTDRFGKYAEKTIGVIVPVIDDEWEDGNVNGWKFYAGQDIKLLKDPDKAYKGDYVFYDSRHVAISKTIPLTDLQINTNYEITVYAKAESGDHHLKVTYKKDPAGPEEPPVFNRLISTGTLVEKDYRELKGTFRVTELNKAPLIIVENFGAGYIGGIRIVKIS

SEQ ID NO: 237 - protein, 721 aa, Bacillus thuringiensis EG4140
MKDSISKGYDEITVQASDYIDIRSIFQTNGSATFNSTTNITTLTQATNSQAGAIAGKTALDMRHDFTFRADIFLGTKSNGADGIAIAFHRGSIGFVGEKGGGLGILGALKGIGFELDTYANAPQDEQGDSFGHGAMRGLFPGFPNGYPHAGFVSTDKNRGWLSALAQMQRIAAPNGRWRRLAIHWDARNKKLTANLEDLTFNDSTVLVKPRTPRYARWELSNPAFELDQKYTFVIGSATGASNNLHQIGIIEFDAYFTKPTIEANNVSVPVGATFNPKTYPGINLRATDEIDGDLTSEIIVTDNNVNTSKSGVYNVTYYVKNSYGESDEKTIEVTVFSNPTIIASDVEIEKGESFNPLTDSRVRLSAQDSLGNDITSKVKVKSSNVDTSKPGEYDVVFEVTDNFGGKAEKEIKVTVLGQPSIEANDVELEIGDLFNPLTDSQVGLRAKDSLGKDITNDVKVKSSNVDTSKPGEYEVVFEVTDRFGKKAEKSIKVLVLGEPSIEANNVEIEKDERFDPLTDSRVGLRAKDSLGKDITNDVKVKSSNVDTSKPGEYEVVFEVTDRFGKYVKKLIVVIVPVIDDEWEDGNVNGWKFYAGQDITLLKDPEKAYKGEYVFYDSRHAAISKTIPVTDLQVGGNYEITVYVKAESGDHHLKVTYKKDPKGPEEPPVFNRLISTGKLVEKDYRELKGTFRVTELNQAPLIIVENFGAGYIGGIRIVKIS

SEQ ID NO: 238 - protein, 716 aa, Bacillus thuringiensis
MKDSISKGYDEITVQASDYIDISIFQTNGSATFNSTTITTLTQATNSQAGAIGKTALDMRHDFTFRAIFLGTKSNGADGIAIAFHRGSIGFVGEKGGGGILGALKGIGFELDTYANAPQDEQGDSFGHGAMRGLFPGFPNGYPHAGFVSTDKNRGWLSALAQMQRIAAPNGRWRRLAIHWDARNKKLTANLEDLTFNDSTVLVKPRTPRYARWELSNPAFELDQKYTFVIGSATGASNNLHQIGIIEFDAYFTKPTIEANNVSVPVGATFNPKTYPGINLRATDEIDGDLTSEIIVTDNNVNTSKSGVYNVTYYVKNSYGESDEKTIEVTVFSNPTIIASDVEIEKGESFNPLTDSRVRLSAQDSLGNDITSKVKVKSSNVDTSKPGEYDVVFEVTDNFGGKAEKEIKVTVLGQPSIEANDVELEIGDLFNPLTDSQVGLRAKDSLGKDITNDVKVKSSNVDTSKPGEYEVVFEVTDRFGKKAEKSIKVLVLGEPSIEANNVEIEKDERFDPLTDSRVGLRAKDSLGKDITNDVKVKSSNVDTSKPGEYEVVFEVTDRFGKYVKKLIVVIVPVIDDEWEDGNVNGWKFYAGQDITLLKDPEKAYKGEYVFYDSRHAAISKTIPVTDLQVGGNYEITVYVKAESGDHHLKVTYKKDPKGPEEPPVFNRLISTGKLVEKDYRELKGTFRVTELNQAPLIIVENFGAGYIGGIRIVKIS

SEQ ID NO: 239 - protein, 632 aa, Bacillus thuringiensis
MNSKSIIEKGVQENQYIDIRNICSINGSAKFDPNTNITTLTEAINSQAGAIAGKTALDMRRDFTLVADIYLGSKSSGADGIAIAFHRGSIGFIGTMGGGLGILGAPNGIGFEIDTYWKATSDETGDSFGHGQMNGAHAGFVSTNRNASYLTALAPMQKIPAPNNKWRVLTINWDARNNKLTARLQEKSNDASTSTPSPRYQTWELLNPAFDLNQKYTFIIGSATGAANNKHQIGVTLFEAYFTKPTIEANPVDIELGTAFDPLNHEPIGLKATDEVDGDITKDITVEFNDIDTSKPGAYRVTYKVVNSYGESDEKTIEVVVYTKPTITAHDITIKKDLAFDPLNYEPIGLKATDPIDGDITDKIAVKFNNVDTSKPGKYHVTYKVINSYEKIDEKTIEVTVYTKPSIVAHDVEIKKDTAFDPLNYEPIGLKATDPIDGDITDKITVESNDVDTSKPGAYSVKYKVVNNYEESDEKTIAVTVPVIDDGWENGDPTGWKFFSGETITLEDDEEHALNGKWVFYADKHVAIYKQVELKNNIPYQITVYVKPEDEGTVAHHIVKVSFKSDSAGPESEEVINERLIDAEQIQKGYRKLTSIPFTPTTIVPNKKPVIIVENFLPGWIGGVRIIVEPTK

SEQ ID NO: 240 - protein, 267 aa, Bacillus thuringiensis
MGIINIQDEINNYMKEVYGATTVKSTYDPSFKVFNESVTPQFTEIPTEPVNNQLTTKRVDNTGSYPVESTVSFTWTETHTETSAVTEGVKAGTSISTKQSFKFGFVNSDVTLTVSAEYNYSTTNTTTTTETHTWSDSTKVTIPPKTYVEAAYIIQNGTYNVPVNVECDMSGTLFCRGYRDGALIAAVYVSVADLADYNPNLNLTNKGDGIAHFKGSGFIEGAQGLRSIIQVTEYPLDDNKGRSTPITYLINGSLAPNVTLKNSNIKF

SEQ ID NO: 241 - protein, 674 aa, Bacillus thuringiensis jegathesan
MNQYQNKNEYEILESSQNNMNMPNRYPFADDPNAVMKNGNYKDWVNECEGSNISPSPAAAITSKIVSIVLKTLAKAVASSLADSIKSSLGISKTITENNVSQVSMVQVHQIINRRIQETILDLGESSLNGLVAIYNRDYLGALEAWNNNKSNINYQTNVAEAFKTVEREFFTKLKGIYRTSSSQITLLPTFTQAANLHLSMLRDAVMYQEGWNLQSHINYSKELDDALEDYTNYCVEVYTKGLNALRGSTAIDWLEFNSFRRDMTLMVLDLVAIFPNYNPVRYPLSTKISLSRKIYTDPVGRTDSPSFGDWTNTGRTLANFNDLEREVTDSPSLVKWLGDMTIYTGAIDSYRPTSPGDRIGVWYGNINAFYHTGRTDVVMFRQTGDTAYEDPSTFISNILYDDIYKLDLRAAAVSTIQGAMDTTFGVSSSRFFDIRGRNQLYQSNKPYPSLPITITFPGEESSEGNANDYSHLLCDVKILQEDSSNICEGRSSLLSHAWTHASLDRNNTILPDEITQIPAVTAYELRGNSSVVAGPGSTGGDLVKMSYHSVWSFKVYCSELKNYRVRIRYASHGNCQFLMKRWPSTGVAPRQWARHNVQGTFSNSMRYEAFKYLDIFTITPEENNFAFTIDLESGGDLFIDKIEFIPVSGSAFEYEGKQNIEKTQKAVNDLFIN

SEQ ID NO: 242 - protein, 675 aa, Bacillus thuringiensis sotto
MVNPYQNKKESVFYEHSNNQKDIPNRYPFTNNPNAVMKNGNYKDWVNECEGSNVSPSPAAAVTSAIISIVLKTLAKALVSSLVDAIKSSLGISEVITKNNVSQLSMELVNQLINRRIQETIMDLGSASLNGLMSIYKRYLNALEAWDKDKSNITLQENVIEEFKYVESRFFENLKGIYRTSSSQITLLPTFAQAANLHLSMLRDAVMYQEGWNLQSHLDYKMELDIALKDYTNYCVEVYNRGLNALRGSTALDWLEFNSFRRDMTLMVLDLVAIFPNYDPVQYPLPTKIGLSRKIYTDPVGTTRDTDFGNWTLTDRTLANFNDLERDVTDSPSLVKWLVDMNIYTGAIDSYPISGPGGERIGVWYGNMNSFVLTGSRELSYNMYGEIAHEDPITNIRDNDIYKVDLRAAYVATIRNALDSTFGVSSSHFFNVMGKNELYQSKQPYPSYPITITFPGEESLEGNVNDYSHLLCNVKNITGGLRQTSARGRSSLLSHAWTHKSLNPKNIIAADKITHIPAVKGSNLSASSAVIKGPGFTGGDLLRLGPNQFVDYILTPDNPQVSQIYFDVRLRYACMGGANILIQFWNKNWEIGVQLVSTTSSLENLKYENFAYITTRLSFTFGQGGYNMSIYNPTSNPNVIIDKIEFIPVSGTPFEYEGKHKLKNTQADVNNLFLN

SEQ ID NO: 243 - protein, 686 aa, Bacillus thuringiensis FCC-41
MNPYQNKNKYEILESSSDYTKISNKYPFANDPNITMKHMNYKDWMHMCETPTPFSASIIISVISIFGRVLGLSSSFANTSKYIAIITGILGLLGSSSSGSTNVWDNLIKHIEELTDRFIDTSVRFTGMSTVNGLNSQYLYYLDLFEDWYEDQNNEQKRNRLVGTFQTLGLAFINALGYRNTNGQEVRGTLSTAYEVQFLPSYAQAANLHLLLLKDAVTYGDKWILIEPTSNYYNRFKDNIARYTDYCTEYFHKGLDNLKKPGSDAVSWLRFNGFRRDMTLMVLDLITLFPLYDSVQYPLPTQIELSRQIYTDPVGATFSDFSNWTLTNRTLANFNDLEREVTDAPSLLKWLNSIEVYTGAIDSHRPTSPGERIGVWYGNRNTYINPDTNEVSYRFTGELAYENPYTFIGSFFDNDIYKVALRAAAVSTTFGSNDSTFGVSSSQFFNRRGIHQLYESSQPIPSWPITLAFPGEESSEGNANDYSHRLCDVKNITGGLRQTPARGRSSLLSHAWTHSSLKLRNIIAADKITQIPAVKTWEIRGTSSVVAGPGNTGGNLVKMSYHSVWNIKFTCQQLKRYRVRIRYASDGNCQLAMRRWRGGPGYVQEARHTVQRTFSGSMTYDSFKYLDIFTMPAEDYTFNLTIDLESGGALYIDKIEFTPDDITTLEYEGERDLEKTKNTVNDLFTN

SEQ ID NO: 244 - protein, 675 aa, Bacillus thuringiensis jegathesan
MNPYQNKSECEILNAPLNNINMPNRYPFANDPNAVMKNGNYKDWLNECDGITPSIFGTLGVLASIVISTINLATSPSIGDAFALVSSIGEYWPETKTSFPLSVADVNRLIREALDQNAINRATGKFNGLMDTYNTVYLKNLQDWYDTRIPANPQGDSQLREAARRSLEEIERDFRKALAGEFAEAGSQIVLLPIYAQAANIHLLILKDAMQFRTDLGLIRPVGVPITTSAEDPFESEFLLRIKKYTDHCISYYDDGLAKIRSRGSDGETWWEFNKFRREMTLTVLDLVALYPTHNIKLYPIPTQTELSRVVYTDPVGCFGNRKSDIFSRLNFDYLENRLTRPREPFNYLNSVQLFASTVSNSNNGEVLRGNLNKIMFEGGWTASRSGDGVTTGTPFSTMDWSYGWGYPRKHYAEITSRSQALPGLNNSIHVIVGIDSFRAIGPGGQGDHTFSLPGGDMYDCGKVQINPLEDYRNSDHWISDMMTINQSVQLASNPTQTFAFSALSLGWHHSSAGNRNVYVYDKITQIPATKTVREHPMIKGPGFTGGDLADLSSNSDILQYDLRSDYDDRLTEDVPFRIRIRCASIGVSTISVDNWGSSSPQVTVASTAASLDTLKYESFQYVSIPGNYYFDSAPRIRLLRQPGRLLVDRIEIIPVNFFPLSEQENKSVDSLFIN

SEQ ID NO: 245 - protein, 1163 aa, Bacillus thuringiensis finitimus B-1166
MNSEEMNHVNPFEISDNNDVSIPSQRYPFANDPADSVFCADDFLQSYGEFNMDNFGESEPFIDASGAINAAIGVTGTVLGFLGVPFAGALTTFYQKLFGFLFPNNNTKQWEEFMKQVEALIDEKISDAVRNKAISELQGLVNNITLYTEALEEWLENKENPAVRDRVLQRWRILDGFFEQQMPSFAVKGFEVLLLVVYTQAANLHLLSLRDAYIYGAEWGLTPTNIDQNHTRLLRHSAEYTDHCVNWYNTGLKQLENSDAKSWFQYNRFRREMTLSVLDVIALFPAYDVKMYPIPTNFQLTREVYTDVIGKIGRNDSDHWYSANAPSFSNLESTLIRTPHVVDYIKKLKIFYATVDYYGIYGRSGKWVGHIITSATSANTTETRNYGTIVNHDSVELNFEGKNIYKTGSLPQGVPPYQIGYVTPIYFITRAVNFFTVSGSKTSVEKYYSKKDRYYSEGLPEEQGVFSTEQLPPNSIAEPEHIAYSHRLCHVTFISVSNGNKYSKDLPLFSWTHSSVDFDNYVYPTKITQLPATKGYNVSIVKEPGFIGGDIGKNNGQILGKYKVNVEDVSQKYRFRVRYATETEGELGIKIDGRTVNLYQYKKTKAPGDPLTYKAFDYLSFSTPVKFNNASSTIELFLQNKTSGTFYLAGIEIIPVKSNYEEELTLEEAKKAVSSLFTDARNALKIDVTDYQIDQAANLVECISGDLYAKEKIVLLRAVKFAKQLSQSQNLLSDPEFNNVNRENSWTASTSVAIIEGDPLYKGRAVQLSSARDENFPTYLYQKIDESTLKPYTRYQLRGFVEGSENLDVYLIRYGAAHVRMNVPYNLEIIDTSSPVNPCEEVDGLSHRSCNVFDRCKQSISVAPDANTGPDQIDGDPHAFSFHIDTGTVDSTENLGIWVAFKISELDGSAIFGNLELIEVGPLSGEALAQVQRKEEKWKQVLAKKRETTAQTVCSGEASQLTNSSQILKIRNYDLIQNFRIFSLRNTLSIKFKIYTITNYPYSRLNYDLFMELENRIQNASLYMTSNILQNGGFKSDVTSWETTANAEVQQIDGASVLVLSNWNASVAQSVNVQNDHGYVLRVTAKKEGIGNGYVTILDCANHIDTLTFSACRSDSDTSSNELTAYVTKTLEIFPDTEQIRIEIGETEGMFYVESVELIRMEN

SEQ ID NO: 246 - protein, 826 aa, Bacillus thuringiensis higo
MNPYQNKNEYEILDAKRNNCHMSNGYPRHPLANDPQMYLRNAHYKDWLSMCNKNNPVGLIPPESFEWTWLNGTVAALTIVSVIAGILVTAPVSVTAGLITVLGAGAALLAGITPLIWPATTDNTFNKITDATEVLLNKEISEFVRKTANTKIDSLQQLIYYYQNALENWKKNPNDSAARNTVSTRFQIVNAFFVEAMPALSMPGYEVVQLGAYAQAANLHLILLREGIAYADQWNLARDPMHAAGDLHYKEFLDYRNQYINHCSTWYNEGQNEANLKNNGLVYQRTMTLFVLDLIAMFSTYDPRLYTMPIKTEILTRTIYTDGVNRNEPKSIHNPGLFRRLEQMKLHIYEYQGAQFLSGHQNIFRSMNYNHPLIYGPVQGYSSSNINKITTINLGDYDKIYSINTESRNRLVQGSTTFDKINFYGAFNENWLFSVYNQNGPIIKHSNIPGIDAPSTGLNYSNYTHYLSNCIFQSNRNGGSAPDYNTQSYVFGWNHYTIDPTGNYVTDAFEVNKNLPESRYVPQISQVPAVKASDIFNPGRVVNAKVESGPYFTGGDVIVSKAQLDGSGLARTLITFPIIPKRYRASGFRVRMYYAANHTGQVSYGVANINTTGYANFQKTFDGWEYFRARHEHFKYIEFDTTFSLRNSGQLEEHLLHIYYPNTTKISGDQLLIIDKIEFIPVGIPLNQTSEGYNTYDQNTNSYNQNYNNYNQNMDTTYQPNYDNYKQNSSGMYDNPYNQNPKDSYNQNYTDTYDSGYNNSQNVGSNYNQEYNTYNQDTENMYNQSYNNYNSDNNNYNQNSDCMCSPGYNGNYECRCNQRANGNYPK

SEQ ID NO: 247 - protein, 1109 aa, Bacillus thuringiensis finitimus B-1161
MAQTYYKIGVQSTEVNSESIFFNPEVDSSDTVAVVSAGIVVVGTILTAFASFVNPGVVLISFGTLAPVLWPDPEEDPKKIWSQFMKHGEDLLNQTISTAVKEIALAHLNGFKDVLTYYERAFNDWKRNPSANTARLVSQRFENAHFNFVSNMPQLQLPTYDTLLLSCYTEAANLHLNLLHQGVQFADQWNADQPHSPMLKSSGTYYDELLVYIEKYINYCTKTYHKGLNHLKESEKITWDAYNTYRREMTLIVLDLVATFPFYDIRRFPRGVELELTREVYTSLDHLTRPPGLFTWLSDIELYTESVAEGDYLSGIRESKYYTGNQFFTMKNIYGNTNRLSKQLITLLPGEFMTHLSINRPFQTIAGINKLYSLIQKIVFTTFKNDNEYQKNFNVNNQNEPQETTNYPNDYGGSNSQKFKHNLSHFPLIIHKLEFAEYFHSIFALGWTHNSVNSQNLISESVSTQIPLVKAYEVTNNSVIRGPGFTGGDLIELRDKCSIKCKASSLKKYAISLFYAANNAIAVSIDVGDSGAGVLLQPTFSRKGNNNFTIQDLNYKDFQYHTLLVDIELPESEEIHIHLKREDDYEEGVILLIDKLEFKPIDENYTNEMNLEKAKKAVNVLFINATNALKMDVTDYHIDQVANLVECISDDLYAKEKIKFTPCIKFAKQLSQARNLLSDPNFNNLNAENSWTANTGVTIIEGDPLYKGRAIQLSAARDENFPTYLYQKIDESLLKPYTRYQLRGFVEGSQDLELDLVRYGATDIVMNVPGDLEILSYSAPINPCEEIETRLDTTCGALDRCKQSNYVNSAADVRPDQVNGDPHAFSFHIDTGTTDNNRNLGIWIIFKIATPDGYATFGNLELIELGPLSGEALAQVQRKEQKWGKNTTQKREEAAKLYAAAKQTINQLFADSQGTKLRFDTEFSNILSADKLVYKIRDVYSEVLSVIPGLNYDLFMELENRIQNAIDLYDARNTVTNGEFRNGLANWMASSNTEVRQIQAHPCWYSLGWNAQVAQSLNVKPDHGYVLRVTAKKEGIGNGYVTILDCANHIDTLTFSSCDSGFTTSSNELAAYVTKTLEIFPDTDQIRIEIGETRSTFYVESVDLIRMED

SEQ ID NO: 248 - protein, 1128 aa, Bacillus thuringiensis finitimus
MDKHINKIGVQSTEVNSESIFFNPEVDSSDTVAVVSAGIVVVGTILTAFASFVNPGVVLISFGTLAPVLWPDPEEDPKKIWSQFMKHGEDLLNQTISTAVKEIALAHLNGFKDVLTYYERAFNDWKRNPSANTARLVSQRFENAHFNFVSNMPQLQLPTYDTLLLSCYTEAANLHLNLLHQGVQFADQWNADQPHSPMLKSSGTYYDELLVYIEKYINYCTKTYHKGLNHLKESEKITWDAYNTYRREMTLIVLDLVATFPFYDIRRFPRGVELELTREVYTSLDPPGLNAGPIPEIDFSYLEDHLTRPPGLFTWLSDIELYTESVAEGDYLSGIRESKYYTGNQFFTMKNIYGNTNRLSKQLITLLPGEFITHLSINRGFQTIAGINKLYSLIQKIVFTTFKNDNEYQKNFNVNNQNEPQETTNYPNDYGGSNSQKFKHNLSHFPLIIHQVEFAEYFHSIFALGWTHNSVNSQNLISESVSTQIPLVKAYEVTTNSVIRGPGFTGGDLIELRDKCSIKCKASSLKKYAISLFYAANNAIAVSIDVGDSGAGVLLQPTFSRKGNNNFTIQDLNYKDFQYHTLLVDIELPESEEIHIHLKREDDYEEGVILLIDKLEFKPIDENYTNEMNLEKAKKAVNVLFINATNALKMDVTDYHIDQVANLVECISDDLYAKEKIKLLHAIKFAKQLSQARNLLSDPNFNNLNAENSWTANTGVTIIEGDPLYKGRAIQLSAARDENFPTYLYQKIDESLLKPYTRYQLRGFVEGSQDLELDLVRYGATDIVMNVPGDLEILSYSAPINPCEEIETRLDTTCGALDRCKQSNYVNSAADVRPDQVNGDPHAFSFHIDTGTTDNNRNLGIWIIFKIATPDGYATFGNLELIELGPLSGEALAQVQRKEQKWGKNTTQKREEAAKLYAAAKQTINQLFADSQGTKLRFDTEFSNILSADKLVYKIRDVYSEVLSVIPGLNYDLFMELENRIQNAIDLYDARNTVTNGEFRNGLANWMASSNTEVRQIQDTSVLVLSSWNAQVAQSLNVKPDHGYVLRVTAKKEGIGNGYVTILDCANHIDTLTFSSCDSGFTTSSNELAAYVTKTLEIFPDTDQIRIEIGETEGTFYVESVDLIRMED

SEQ ID NO: 249 - protein, 650 aa, Bacillus thuringiensis medellin
MNSFQNKNEYEILNAPSSISNIPNNYSKYPIANTLNQTMQNTNYKDWTNMCAIDNNLKSINPFEANLQNSLVGLFAITAAIASLLSAPITGGTSIAAGTAIAAAIIPILWPSQENNLPDKLLAISEATLYSFQDQRVREDALTRLESLKDSVKYFENAFTFWINNPNSTNTTTVRERFQEVNGRFVGSMAFFRAKNYEPILLSTYAQAARLHLLHLRDGITYAEKWNLSRQGDDMPGDLLYKEFNKYCNEYIEHCIKWYNESLSLLKSVGANWLEYNQYRTFLTASVLDVISLFSSYDPRLYKERLSVEILTRKLYTDPINYHRGISLEADESKYTLEPTLFTQLYTLTFYSNIFYNYMGHTNTYRYLSPDKIFAERSFGKQSSYIDKVPVIPNDKSIIYKIRAYDNHNGLFNVMYFGFWDGEKDQIQKIIGGSSTEIYIKNCTHRLADVISHDLDEKNKCYSFAWTSTTISLENEIKNDIITQIPAVKAYQLGVQSQVIKGPGHTGGDLINLKSNDYLRISCQHLSNVTKKYFVRIRYATNGSLNTRPIINITIPGMTPQGMVLDNTFSGTGYSNLEYQNFGYKEFLKEVTLNPNQSISLTLNRSDQNSNSILLLDRIEFLPITPSIRKSKEQQNLEKNQKTVNKLFFN

SEQ ID NO: 250 - protein, 633 aa, Bacillus thuringiensis kurstaki
MNNVLNSGRTTICDAYNVVAHDPFSFEHKSLDTIQKEWMEWKRTDHSLYVAPVVGTVSSFLLKKVGSLIGKRILSELWGIIFPSGSTNLMQDILRETEQFLNQRLNTDTLARVNAELIGLQANIREFNQQVDNFLNPTQNPVPLSITSSVNTMQQLFLNRLPQFQIQGYQLLLLPLFAQAANMHLSFIRDVILNADEWGISAATLRTYRDYLRNYTRDYSNYCINTYQTAFRGLNTRLHDMLEFRTYMFLNVFEYVSIWSLFKYQSLMVSSGANLYASGSGPQQTQSFTAQNWPFLYSLFQVNSNYILSGISGTRLSITFPNIGGLPGSTTTHSLNSARVNYSGGVSSGLIGATNLNHNFNCSTVLPPLSTPFVRSWLDSGTDREGVATSTNWQTESFQTTLSLRCGAFSARGNSNYFPDYFIRNISGVPLVIRNEDLTRPLHYNQIRNIESPSGTPGGARAYLVSVHNRKNNIYAANENGTMIHLAPEDYTGFTISPIHATQVNNQTRTFISEKFGNQGDSLRFEQSNTTARYTLRGNGNSYNLYLRVSSIGNSTIRVTINGRVYTVSNVNTTTNNDGVNDNGARFSDINIGNIVASDNTNVTLDINVTLNSGTPFDLMNIMFVPTNLPPLY

SEQ ID NO: 251 - protein, 633 aa, Bacillus thuringiensis; identical to SEQ ID NO: 250

SEQ ID NO: 252 - protein, 635 aa, Bacillus thuringiensis
MNNVLNSGKTTICNAYNVVAHDPFSFEHKSLDTIQEEWMEWKRTDHSLYVAPVVGTVSSFLLKKVGSLIGKRILSELWGLIFPSGSTNLMQDILRETEQFLNQRLNTDTLDRVNAELEGLQANIREFNQQVDNFLNPTQNPVPLSITSSVNTMQQLFLNRLPQFQIQGYQLLLLPLFAQAANMHLSFIRDVILNADEWGISAATLRTYRDYLRNYTRDYSNYCINTYQTAFRGLNTRLHDMLEFRTYMFLNVFEYVSIWSLFKYQSLMVSSGANLYASGSGPQQTQSFTAQNWPFLYSLFQVNSNYILSGISGNRLSTTFPNIGGLPGSTTIHSLNSARVNYSGGVSSGLIGATNLNHNFNCSTVLPPLSTPFVRSWLDSGTDREGVATSTTWQTESFQITSGLRCGAFPFSARGNSNYFPDYFIRNISGVPLVIRNEDLTRPLHYNQIRNIESPSGTPGGLRAYMVSVHNRKNNIYAAHENGTMIHLAPEDYTGFTISPIHATQVNNQTRTFISEKFGNQGDSLRFEQSNTTARYTLRGNGNSYNLYLRVSSIGNSTIRVTINGRVYTASNVNTNTNNDGVNDNGARFSDINIGNVVASDNTNVPLDINVTLNSGTQFELMNIMFVPTNLPPLY

SEQ ID NO: 253 - protein, 633 aa, Bacillus thuringiensis Rpp39
MNNVLNSGRTTICDAYNVVAHDPFSFEHKSLDTIQKEWMEWKRTDHSLYVAPVVGTVSSFLLKKVGSLIGKRILSELWGIIFPSGSTNLMQDILRETEQFLNQRLNTDTLARVNAELIGLQANIREFNQQVDNFLNPTQNPVPLSITSSVNTMQQLFLNRLPQFQIQGYQLLLLPLFAQAANMHLSFIRDVILNADEWGISAATLRTYRDYLRNYTRDYSNYCINTYQTAFRGLNTRLHDMSEFRTYMFLNVFEYVSIWSLFKYQSLMVSSGANLYASGSGPQQTQSFTAQNWPFLYSLFQVNSNYILSGISGTRLSITFPNIGGLPGSTTTHSLNSARVNYSGGVSSGLIGATNLNHNFNCSTVLPPLSTPFVRSWLDSGTDREGVATSTNWQTESFQTTLSLRCGAFSARGNSNYFPDYFIRNISGVPLVIRNEDLTRPLHYNQIRNIESPSGTPGGARAYLVSVHNRKNNIYAANENGTMIHLAPEDYTGFTISPIHATQVNNQTRTFISEKFGNQGDSLRFEQSNTTARYTLRGNGNSYNLYLRVSSIGNSTIRVTINGRVYTVSNVNTTTNNDGVNDNGARFSDINIGNIVASDSTNVTLDINVTLNSGTPFDLMNIMFVPTNLPPLY

SEQ ID NO: 254 - protein, 633 aa, Bacillus thuringiensis 146-158-01
MNSVLNSGRTTICDAYNVAAHDPFSFQHKSLDTVQKEWTEWKKNNHSLYLDPIVGTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDMLEFRTYMFLNVFEYVSIWSLFKYQSLIVSSGANLYASGSGPQQTQSFTAQNWPFLYSLFQVNSNYILSGISGTRLSITFPNIGGLPGSTTTHSLNSARVNYSGGVSSGLIGATNLNHNFNCSTVLPPLSTPFVRSWLDSGTDREGVATSTNWQTESFQTTLSLRCGAFSARGNSNYFPDYFIRNISGVPLVIRNEDLTRPLHYNQIRNIESPSGTPGGARAYLVSVHNRKNNIYAANENGTMIHLAPEDYTGFTISPIHATQVNNQTRTFISEKFGNQGDSLRFEQSNTTARYTLRGNGNSYNLYLRVSSIGNSTIRVTINGRVYTVSNVNTTTNNDGVNDNGARFSDINIGNIVASDNTNVTLDINVTLNSGTPFDLMNIMFVPTNLPPLY

SEQ ID NO: 255 - protein, 633 aa, Bacillus thuringiensis HD-550
MNSVLNSGRTTICDAYNVVAHDPFSFEHKSLDTIQKEWMEWKRTDHSLYVAPVVGTVSSFLLKKVGSLFGKRILSELWGIIFPSGSTNLMQDILRETEQFLNQRLNTDTLARVNAELIGLQANIREFNQQVDNFLNPTQNPVPLSITSSVNTMQQLFLNRLPQFQIQGYQLLLLPLFAQAANMHLSFIRDVILNADEWGISAATLRTYRDYLRNYTRDYSNYCINTYQTAFRGLNTRLHDMLEFRTYMFLNVFEYVSIWSLFKYQSLMVSSGANLYASGSGPQQTQSFTAQNGPFLYSLFQVNSNYILSGISGTRLSITFPNIGGLPGSTTTHSLNSARVNYSGGVSSGLIGATNLNHNFNCSTVLPPLSTPFVRSWLDSGTDREGVATSTNWQTESFQTTLSLRCGAFSARGNSNYFPDYFIRNISGVPLVIRNEDLTRPLHYNQIRNIESPSGTPGGARAYLVSVHNRKNNIYAANENGTMIHLAPEDYTGFTISPIHATQVNNQTRTFISEKFGNQGDSLRFEQSNTTARYTLRGNGNSYNLYLRVSSIGNSTIRVTINGRVYTVSNVNTTTNNDGVNDNGARFSDINIGNIVASDNTNVTLDINVTLNSGTPFDLMNIMFAPTNLPPLY

SEQ ID NO: 256 - protein, 633 aa, Bacillus thuringiensis kurstaki HD1; identical to SEQ ID NO: 250

SEQ ID NO: 257 - protein, 635 aa, Bacillus thuringiensis sotto
MNNVLNSGKTTICNAYNVVAHDPFSFEHKSLDTIQEEWMEWKRTDHSLYVAPVVGTVSSFLLKKVGSLIGKRILSELWGLIFPSGSTNLMQDILRETEQFLNQRLNTDTLDRVNAELEGLQANIREFNQQVDNFLNPTQNPVPLSITSSVNTMQQLFLNRLPQFQIQGYQLLLLPLFAQAANMHLSFIRDVILNADEWGISAATLRTYRDYLRNYTRDYSNYCINTYQTAFRGLNICLHDMLEFRTYMFLNVFEYVSIWSLFKYQSLMVSSGANLYASGSGPQQTQSFTAQNWPFLYSLFQVNSNYILSGISGNRLSTTFPNIGGLPGSTTIHSLNSARVNYSGGVSSGLIGATNLNHNFNCSTVLPPLSTPFVRSWLDSGTDREGVATSTTWQTESFQITSGLRCGAFPFSARGNSNYFPDYFIRNISGVPLVIRNEDLTRPLHYNQIRNIESPSGTPGGLRAYMVSVHNRKNNIYAAHENGTMIHLAPEDYTGFTISPIHATQVNNQTRTFISEKFGNQGDSLRFEQSNTTARYTLRGNGNSYNLYLRVSSIGNSTIRVTINGRVYTASNVNTNTNNDGVNDNGARFSDINIGNVVASDNTNVPLDINVTLNSGTQFELMNIMFVPTNLPPLY

SEQ ID NO: 258 - protein, 633 aa, Bacillus thuringiensis kenyae HD549
MNSVLNSGRTTICDAYNVVAHDPFSFEHKSLDTIQKEWMEWKRTDHSLYVAPVVGTVSSFLLKKVGSLIGKRILSELWGIIFPSGSTNLMQDILRETEQFLNQRLNTDTLARVNAELIGLQANIREFNQQVDNFLNPTQNPVPLSITSSVNTMQQLFLNRLPQFQIQGYQLLLLPLFAQAANMHLSFIRDVILNADEWGISAATLRTYRDYLRNYTRDYSNYCINTYQTAFRGLNTRLHDMLEFRTYMFLNVFEYVSIWSLFKYQSLMVSSGANLYASGSGPQQTQSFTAQNWPFLYSLFQVNSNYILSGISGTRLSITFPNIGGLPGSTTTHSLNSARVNYSGGVSSGLIGATNLNHNFNCSTVLPPLSTPFVRSWLDSGTDREGVATSTNWQTESFQTTLSLRCGASSARGNSNYFPDYFIRNISGVPLVIRNEDLTRPLHYNQIRNIESPSGTPGGARAYLVSVHNRKNNIYAANENGTMIHLAPEDYTGFTISPIHATQVNNQTRTFISEKFGNQGDSLRFEQSNTTARYTLRGNGSSYNLYLRVSSIGNSTIRVTINGRVYTVSNVNTTTNNDGVNDNGARFPDINIGNIVASDNTNVTLDINVTLNSGTPFDLMNIMFVPTNLPPLY

SEQ ID NO: 259 - protein, 633 aa, Bacillus thuringiensis SL39
MNNVLNSRRTTICDAYNVVAHDPFSFEHKSLDTIQKEWMEWKRTDHSLYVAPVVGTVSSFLLKKVGSLIGKRILSELWGIIFPSSSTNLMQDILRETEQFLNQRLNTDTLARVNAELIGLQANIREFNQQVDNFLNPTQNPVPLSITSSVNTMQQLFLNRLPQFQIQGYQLLLLPLFAQAANMHLSFIRDVILNADEWGISAATLRTYRDYLRNYTRDYSNYCINTYQTAFRGLNTRLHDMLEFRTYMFLNVFEYVSIWSLFKYQSLMVSSGANLYASGGGPQQTQSFTAQNWPFLYSLFQVNSNYILSGISGTRLSITFPNIGGLPGSTTTHSLNSARVNYSGGVSSGLIGATNLNHNFNCSTVLPPLSTPFVRSWLDSGTDREGVATSTNWQTESFQTTLSLRCGAFSARGNSNYFPDYFIRNISGVPLVIRNEDLTRPLHYNQIRNIESPSGTPGGARAYLVSVHNRKNNIYAANENGTMIHLAPEDYTGFTISPIHATQVNNQTRTFISEKFGNQGDSLRFEQSNTTARHTLRGNGNSYNLYLRVSSIGNSTIRVTINGRVYTVSNVNTTTNNDGVNDNGARFSDINIGNIVASDNTNVTLDINVTLNSGTPFDLMNIMFVPTNLPPLY

SEQ ID NO: 260 - protein, 633 aa, Bacillus thuringiensis YZ71
MNNVLNSGRTTICDAYNVVAHDPFSFEHKSLDTIQKEWMEWRRTDHSLYVAPVVGTVSSFLLKKVGSLIGKRILSELWGIIFPSGSTNLMQDILRETEQFLNQRLNTDTLARVNAELIGLQANIREFNQQVDNFLNPTQNPAPLSITSSVNTMQQLFLNRLPQFQIQGYQLLLLPLFAQAANMHLSFIRDVILNADEWGISAATLRTYRDYLRNYTRDYSNYCINTYQTAFRGLNTRLHDMLEFRTYMFLNVFEYVSIWSLFKYQSLMVSSGANLYASGSGPQQTQSFTAQNWPFLYSLFQVNSNYILSGISGTRLSITFPNIGGLPGSTTTHSLNSARVNYSGGVSSGLIGATNLNHNFNCSTVLPPLSTPFVRSWLDSGTDREGVATSTNWQTESFQTTLSLRCGAFSARGNSNYFPDYFIRNISGVPLVIRNEDLTRPLHYNQIRNIESPSGTPGGARAYLVSVHNRKDNIYAANENGTMIHLAPEDYTGFTISPIHATQVNNQTRTFISEKFGNQGDSLRFEQSNTTARYTLRGNGNSYNLYLRVSSIGNSTIRVTINGRVYTVSNVNTTTNNDGVNDNGARFSDINIGNIVASDNTNVTLDINVTLNSGTPFDLMNIMFVPTNPPPLY

SEQ ID NO: 261 - protein, 551 aa, Bacillus thuringiensis CY29
MNNVLNSRRTTICDAYNVVAHDPFSFEHKSLDTIQKEWMEWKRTDHSLYVAPVVGTVSSFLLKKVGSLIGKRILSELWGIIFPSSSTNLMQDILRETEQFLNQRLNTDTLARVNAELIGLQANIREFNQQVDNFLNPTQNPVPLSITSSVNTMQQLFLNRLPQFQIQGYQLLLLPLFAQAANMHLSFIRDVILNADEWGISAATLRTYRDYLRNYTRDYSNYCINTYQTAFRGLNTRLHDMLEFRTYMFLNVFEYVSIWSLFKYQSLMVSSGANLYASGGGPQQTQSFTAQNWPFLYSLFQVNSNYILSGISGTRLSITFPNIGGLPGSTTTHSLNSARVNYSGGVSSGLIGATNLNHNFNCSTVLPPLSTPFVRSWLDSGTDREGVATSTNWQTESFQTTLSLRCGAFSARGNSNYFPDYFIRNISGVPLVIRNEDLTRPLHYNQIRNIESPSGTPGGARAYLVSVHNRKNNIYAANENGTMIHLAPEDYTGFTISPIHATQVNNQTRTFISEKFGNQGDSLRFEQSNTTARHTLRGNGNSYNLYLRVSS

SEQ ID NO: 262 - protein, 633 aa, Bacillus thuringiensis Dongbei 66
MNNVLNSGRTTICDAYNVVAHDPFSFEHKSLDTIQKEWMEWKRTDHSLYVAPVVGTVSSFLLKKVGSLIGKRILSELWGIIFPSGSTNLMQDILRETEQFLNQRLNTDTLARVNAELIGLQANIREFNQQVDNFLNPTQNPVPLSITSSVNTMQQLFLNRLPQFQIQGYQLLLLPLFAQAANMHLSFIRDVILNADEWGISAATLRTYRDYLRNYTRDYSNYCINTYQTAFRGLNTRLHDMLEFRTYMFLNVFEYVSIWSLFKYQGLMVSSGANLYASGSGPQQTQSFTAQNWPFLYSLFQVNSNYILSGISGTRLSITFPNIGGLPGSTTTHSLNSARVNYSGGVSSGLIGATNLNHNFNCSTVLPPLSTPFVRSWLDSGTDREGVATSTNWQTESFQTTLSLRCGAFSARGNSNYFPDYFIRNISGVPLVIRNEDLTRPLHYNQIRNIESPSGTPGGARAYLVSVHNRKNNIYAANENGTMIHLAPEDYTGFTISPIHATQVNNQTRTFISEKFGNQGDSLRFEQSNTTARYTLRGNGNSYNLYLRVSSIGNSTIRVTINGRVYTVSNVNTTTNNDGVNDNGARFSDINIGNIVASDNTNVTLDINVTLNSGTPFDLMNIMFVPTNLPPLY

SEQ ID NO: 263 - protein, 633 aa, Bacillus thuringiensis; identical to SEQ ID NO: 250

SEQ ID NO: 264 - protein, 633 aa, Bacillus thuringiensis kurstaki HD1
MNSVLNSGRTTICDAYNVAAHDPFSFQHKSLDTVQKEWTEWKKNNHSLYLDPIVGTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDMLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNISPLY

SEQ ID NO: 265 - protein, 633 aa, Bacillus thuringiensis CMBL-BT1
MNTVLNNGRTTICDAYNVAAHDPFSFQHKSLDTVQKEWTEWKKNNHSLYLDPIVGTVASFLLKKVGSLVGKRILSELRNLIFPSGSTNLMQDILRETEKFLNQRLNTDTVARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDMLEFRTYMFLNVFEYVSIWSLFKYQSLLVSSGANSYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGISNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNLPPLY

SEQ ID NO: 266 - protein, 633 aa, Bacillus thuringiensis LyD
MNSVLNSGRTTICDAYNVAAHDPFSFQHKSLDTVQKEWTEWKKNNHSLYLDPIVGTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDMLEFRTYMFLNVFEYVSFWSVFKYQSLLVSSGANLNARGRGPQQAQSFTSPGWAFLNSLFQVNSNYVFNGFRGARLFNSFPNIIGLPGFTTTHPLLAAKVNYKGRISSGDIGASPVNQNFNCSKFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVARSNSDVSLDINVSLNSRTLIDLMNIMLVPTNISPLY

SEQ ID NO: 267 - protein, 633 aa, Bacillus thuringiensis ywc5-4
MNSVLNIGRTTICDAYNVAAHDPFSFQHKSLDTVQKEWTEWKKNNHSLYLDPIVGTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDMLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYQSDYFIRNISGVPLVVRNEDLRRPLHYNEIRNIASPSGTPGGARAYLVSVHNRKNNIHAVHENGSLIHLAPNDYTGFTISPIHATQVNNQTRTFISEKFGNQGDSLRFEQNNTTARYTLRGNGNSYNLYLRVSSIGNSTIRVTINGRVYTATTVNTTTNNDGVNDNGARFSDINIGNVVASSNSDVPLDINVTLNSGTQFDLMNIMLVPTNISPLY

SEQ ID NO: 268 - protein, 633 aa, Bacillus thuringiensis Bts
MNSVLNTGRTTICDAYNVAAHDPFSFQHKSLDTVQKEWTEWKKNNHSLYLDPIVGTVASFLLKKVGSLVGKRILSELRNLIFPSGSTNLMQDILRETEKFLNQRLNTDTLARVNAELTGLQADVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDMLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWRTESFETTLGLRSGAFTARGNSNYYSDYFIRNISGVPLVVRNEDLRRPLHYNEIRNIASPSGTPGGARAYLVSVHNRKNNIHAVHENGSLIHLAPNDYTGFTISPIHATQVNNQTRTFISEKFGNQGDSLRFEQNNTTARYTLRGNGNSYNLYLRVSSIGNSTIRVTINGRVYTATTVNTTTNNDGVNDNGARFSNINIGNVVASSNSDVPLDINVTLNSGTQFDLMNTMLVPTNISPLY

SEQ ID NO: 269 - protein, 634 aa, Bacillus thuringiensis BF-4
MNSVLNSGRTTICDAYNVAAHDPFSFQHKSLDTVQKEWTEWKKNNHSLYLDPIVGTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDMLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSECTSLDINVTLNSGTQFDLMNIMLVPTNISPLY

SEQ ID NO: 270 - protein, 633 aa, Bacillus thuringiensis SK-793; identical to SEQ ID NO: 264

SEQ ID NO: 271 - protein, 633 aa, Bacillus thuringiensis kurstaki HD1; identical to SEQ ID NO: 264

SEQ ID NO: 272 - protein, 633 aa, Bacillus thuringiensis; identical to SEQ ID NO: 264

SEQ ID NO: 273 - protein, 633 aa, Bacillus thuringiensis BTC002; identical to SEQ ID NO: 264

SEQ ID NO: 274 - protein, 633 aa, Bacillus thuringiensis B-Pr-88
MNSVLNSGRTTICDAYNVAAHDPFSFQHKSLDTVQKEWTEWKKNNHSLYLDPIVGTVASFLLKKVGSLVGKRILSELRNLIFPSGSTNLMQDILRETEKFLNQRLNTDTVARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDMLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGISNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNISPLY

SEQ ID NO: 275 - protein, 633 aa, Bacillus thuringiensis ly30
MNSVLNSGRTTICDAYNVAAHDPFSFQHKSLDTVQKEWTEWKKNNHSLYLDPIVGTVASFLLKKVGSLVGKRILSELRNLIFPSGSTNLMQDILRETEKFLNQRLNTDTLARVNAELTELQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDMLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNISPLY

SEQ ID NO: 276 - protein, 633 aa, Bacillus thuringiensis WZ-7
MNSVLNSGRTTICDAYNVAAHDPFSFQHKSLDTVQKEWTEWKKNNHSLYLDPIVGTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDMLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNGIRNIASPSGTPGGARAYMVSVHNRKNNIHAVHENGSMIHLAPNDYTGFTILPIHATQVNNQTRTFISGKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNISPLY

SEQ ID NO: 277 - protein, 633 aa, Bacillus thuringiensis WB2
MNSVLNSGRTTICDAYNVAAHDPFSFQHKSLDTVQKEWTEWKKNNHSLYLDPIVGTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDMLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTVRGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNLPPLY

SEQ ID NO: 278 - protein, 633 aa, Bacillus thuringiensis LLB6
MNNVLNSGRTTICDAYNVAAHDPFSFQHKSLDTVQKEWTEWKKNNHSLYLDPIVGTVASFLLKKVGSLVGKRILSELRNIIFPSGSTNLMQDILRETEKFLNQRLNTDTVARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDMLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGISNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTKLPPLY

SEQ ID NO: 279 - protein, 622 aa, Bacillus thuringiensis shanghai S1
MNTVLNNGRNTTCHAHNVVAHDPFSFEHKSLNTIEKEWKEWKRTDHSLYVAPIVGTVGSFLLKKVGSLVGKRILSELQNLIFPSGSIDLMQEILRATEQFINQRLNADTLGRVNAELAGLQANVAEFNRQVDNFLNPNQNPVPLAIIDSVNTLQQLFLSRLPQFQIQGYQLLLLPLFAQAANFNLSFIRGVILNADEWGISAATVRTYRDHLRKFHRDYSNYCINPYQTAFRGLNHRLPDMLEFRTYMFLNVFEYVSIWSLFKYQSLLVSSGANLYASGSGPTQSFTAQNWPFLYSLFQVNSNYVLNGLSGARTTITFPNIGGLPVYHNSTLHFARINYRGGVSSSRIGQANLNQNFNISTLFNPLQTPFIRSWLDSGTDREGVATSTNWQSGAFETTLLRFSIFSARGNSNFFPDYFIRNISGVVGTISNADLARPLHFNEIRDIGTTAVASLVTVHNRKNNIYDTHENGTMIHLAPNDYTGFTVSPIHATQVNNQIRTFISEKYGNQGDSLRFELSNPTARYTLRGNGNSYNLYLRVSSIGSSTIRVTINGRVYTANVNTTTNNDGVLDNGARFSDINIGNVVASANTNVPLDIQVTFNGNPQFELMNIMFVPTNLPPLY

SEQ ID NO: 280 - protein, 623 aa, Bacillus thuringiensis QCL-1
MNTVLNNGRNTTCHAPNVVAHDPFSFEHKSLNTIEKEWKEWKRTDHSLYVAPIVGTVGSFLLKKVGSLVGKRILSELQNLIFPSGSIDLMQEILRATEQFINQRLNADTLGRVNAELAGLQANVAEFNRQVDNFLNPNQNPVPLAIIDSVNTLQQLFLSRLPQFQIQGYQLLLLPLFAQAANLHLSFIRDVILNADEWGISAATVRTYRDHLRNFTRDYSNYCINTYQTAFRGLNTRLHDMLEFRTYMFLNVFEYVSIWSLFKYQSLLVSSGANLYASGSGPTQSFTAQNWPFLYSLFQVNSNYVLNGLSGARTTITFPNIGGLPGSTTTQTLHFARINYRGGVSSSRIGQANLNQNFNISTLFNPLQTPFIRSWLDSDTDREGVATSTNWQSGAFETTLLRFSIFSARGNSNFFPDYFIRNISGVVGTISNADLARPLHFNEIRDIGTTAVASLVTVHNRKNNIYDTHENGTMIHLAPNDYTGFTVSPIHATQVNNQIRTFISEKYGNQGDSLRFELSNTTARYTLRGNGNSYNLYLRVSSIGSSTIRVTINGRVYTANVNTTTNNDGVLDNGARFSDINIGNVVASANTNVPLDIQVTFNGNPQFELMNIMFVPTNLPPLY

SEQ ID NO: 281 - protein, 623 aa, Bacillus thuringiensis HD29
MNTVLNNGRNTTCHAHNVVAHDPFSFEHKSLNTIEKEWKEWKRTDHSLYVAPIVGTVGSFLLKKVGSLVGKRILSELQNLIFPSGSIDLMQEILRATEQFINQRLNADTLGRVNAELAGLQANVAEFNRQVDNFLNPNQNPVPLAIIDSVNTLQQSFLSRLPQFQIQGYQLLLLPLFAQAANLHLSFIRDVILNADEWGISAATVRTYRDHLRNFTRDYSNYCINTYQTAFRGLNTRLHDMLEFRTYMFLNVFEYVSIWSLFKYQSLLVSSGANLYASGSGPTQSFTAQNWPFLYSLFQVNSNYVLNGLSGARTTITFPNIGGLPGSTTTQTLHFARINYRGGVSSSRIGQANLNQNFNISTLFNPLQTPFIRSWLDSGTDREGVATSTNWQSGAFETTLLRFSIFSARGNSNFFPDYFIRNISGVVGTISNADLARPLHFIEIRDIGTTAVASLVTVHNRKNNIYDTHENGTMIHLAPNDYTGFTVSPIHATQVNNQIRTFISEKYGNQGDSLRFELSNTTARYTLRGNGNSYNLYLRVSSIGSSTIRVTINGRVYTANVNTTTNNDGVLDNGARFSDINIGNVVASANTNVPLDIQVTFNGNPQFELMNIMFVPTNLPPLY

SEQ ID NO: 282 - protein, 623 aa, Bacillus thuringiensis CMBL-BT3
MNTVLNNGRNTTCHAHNVVAHDPFSFEHKSLNTIEKEWKEWKRTDHSLYVAPIVGTVGSFLLKKVGSLVGKRILSELQNLIFPSGSIDLMQEILRATEQFINQRLNADTLGRVNAELAGLQANVAEFNRQVDNFLNPNQNPVPLAIIDSVNTLQQLFLSRLPQFQIRGYQLLLLPLFAQAANLHLSFIRDVILNADEWGISAATVRTYRDHLRNFTRDYSNYCINTYQTAFRGLNTRLHDMLEFRTYMFLNVFEYVSIWSLFKYQSLLVSSGANLYASSSGPTQSFTAQNWPFLYSLFQVNSNYVLNGLSGARTTITFPNIGGLPGSTTTQTLHVARINYRGGVSSSRIGQANLNQNFNISTLFNPLQTPFIRSWLDSGTDREGVATSTNWQSGAFETTLLRFSIFSARGNSNFFPDYFIRNISGVVGTISNADLARPLHFNEIRDIGTTAVASLVTVHNRKNNIYDTHENGTMIHLAPNDYTGFTVSPIHATQVNNQIRTFISEKYGNQGDSLRFELSNTTARYTLRGNGNSYNLYLRVSSIGSSTIRVTINGRVYTANVNTTTNNDGVLDNGARFSDINIGNVVASANTNVPLDIQVTFNGNPQFELMNIMFVPTNLPPLY

SEQ ID NO: 283 - protein, 623 aa, Bacillus thuringiensis
MNTVLNNGRNTTCHAHNVVAHDPFSFEHKSLNTIEKEWKEWKRTDHSLYVAPIVGTVGSFLLKKVGSLVGKRILSELQNLIFPSGSIDLMQEILRATEQFINQRLNADTLGRVNAELAGLQANVAEFNRQVDNFLNPNQNPVPLAIIDSVNTLQQLFLSRLPQFQIQGYQLLLLPLFAQAANLHLSFIRDVILNADEWGISAATVRTYRDHLRNFTRDYSNYCINTYQTAFRGLNTRLHDMLEFRTYMFLNVFEYVSIWSLFKYQSLLVSSGANLYASGSGPTQSFTAQNWPFLYSLFQVNSNYVLNGLSGARTTITFPNIGGLPGSTTTQTLHFARINYRGGVSSSRIGQANLNQNFNISTLFNPLQTPFIRSWLDSGTDREGVATSTNWQSGAFETTLLRFSIFSARGNSNFFPDYFIRNISGVVGTISNADLARPLHFNEIRDIGTTAVASLVPVHNRKNNIYATHENGTMIHLAPNDYTGFTVSPIHATQVNNQIRTFISEKYGNQGDSLRFELSNTTARYTLRGNGNSYNLYLRVSSIGSSTIRVTINGRVYTANVNTTTNNDGVLDNGARFSDINIGNVVASANTNVPLDIQVTFNGNPQFELMNIMFVPTNLPPLY

SEQ ID NO: 284 - protein, 625 aa, Bacillus thuringiensis
MNTVLNNGRNTTCHAHNVVAHDPFSFEHKSLNTIEKEWKEWKRTDHSLYVAPIVGTVGSFLLKKVGSLVGKRILSELQNLIFPSGSIDLMQEILRATEQFINQRLNADTLGRVNAELAGLQANVAEFNRQVDNFLNPNQNPVPLAIIDSVNTLQQLFLSRLPQFQIQGYQLLLLPLFAQAANLHLSFIRDVILNADEWGISAATVRTYRDHLRNFTRDYSNYCINTYQTAFRGLNTRLHDMLEFRTYMFLNVFEYVSIWSLFKYQSLLVSSGANLYASGSGPTQSFTAQNWPFLYSLFQVNSNYVLNGLSGARTTITFPNIGGLPGSTTTQTLHFARINYRGGVSSSRIGQANLNQNFNISTLFNPLQTPFIRSWLDSGTDREGVATSTNWQSGAFETTLLRFSIFSARGNSNFFPDYFIRNISGVVGTISNADLARPLHFNEIRDIGTTAVASLVTVHNRKNNIYDTHENGTMIHLAPNDYTGFTVSPIHATQVNNQIRTFISEKYGNQGDSLRFELSNTTARYTLRGNGNSYNLYLRVSSIGSSTIRVTINGRVYTANVNTTTNNDGVLDNGARFSDINIGNVVASANTNVPLDIQVTFNDNPQFELMNIMLFQLIFHHFIKV

SEQ ID NO: 285 - protein, 623 aa, Bacillus thuringiensis WB9
MNSVLNSGRNTTCHAHNVVAHDPFSFEHKSLNTIEKEWKEWKRTDHSLYVAPIVGTVGSFLLKKVGSLVGKRILSELQNLIFPSGSIDLMQEILRATEQFINQRLNADTLGRVNAELAGLQANVAEFNRQVDNFLNPNQNPVPLAIIDSVNTLQQLFLSRLPQFQIQGYQLLLLPLFAQAANLHLSFIRDVILNADEWGISAATVRTYRDHLRNFTRNYSNYCINTYQTAFRGLNTRLHDMLEFRTYMFLNVFEYVSIWSLFKYQSLLVSSGANLYASGSGPTQSFTAQNWPFLYSLFQVNSNYVLNGLSGARTTITFPNIGGLPGSTTTQTLHFARINYRGGVSSSRIGQANLNQNFNISTLFNPLQTPFIRSWLDSGTDREGVATSTNWQSGAFETTLLRFSIFSARGNSNFFPDYFIRNISGVVGTISNADLARPLYFNEIRDIGTTAVASLVTVHNRKNNIYDTHENGTMIHLAPNDYTGFTVSPIHATQVNNQIRTFISEKYGNQGDSLRFELSNTTARYTLRGNGNSYNLYLRVSSIGSSTIRVTINGRVYTANVNTTTNNDGVLDNGARFSDINIGNVVASANTNVPLDIQVTFNGNPQFELMNIMFVPTNIPPLY

SEQ ID NO: 286 - protein, 623 aa, Bacillus thuringiensis
MNNVLNSGRNTTCHAHNVVAHDPFSFEHKSLNTIEKEWKEWRRTDHSLYVAPIVGTVGSFLLKKVGSLVGKRILSELQNLIFPSGSIDLMQEILRATEQFINQRLNADTLGRVNAELAGLQANVAEFNRQVDNFLNLNQNPVPLAIIDSVNTLQQLFLSRLPQFQIQGYQLLLLPLFAQAANLHLSFIRDVILNADEWGISAATVRTYRDHLRNFTRDYSNYCINTYQTAFRGLNTRLHDMLEFRTYMFLNVFEYVSIWSLFKYQSLLVSSGANLYASGSGPTQSFTAQNWPFLYSLFQVNSNYVLNGLSGARTTITFPNIGGLPGSTTTQTLHFARINYRGGVSSSRIGQANLNQNFNISTLFNPLQTPFIRSWLDSGTDREGVATSTNWQSGAFETTLLRFSIFSARGNSNFFPDYFIRNISGVVGTISNADLARPLHFNEIRDIGTTAVASLVTVHNRKNNIYDTHENGTMIHLAPNDYTGFTVSPIHATQVNNQIRTFISEKYGNQGDSLRFELSNTTARHTLRGNGNSYNLYLRVSSIGSSTIRVTINGRVYTANVNTTTNNDGVLDNGARFSDINIGNVVASANTNVPLDIQVTFNGNPQFELMNIMFVPTNIPPLY

SEQ ID NO: 287 - protein, 623 aa, Bacillus thuringiensis wuhanensis
MNTVLNNGRNTTCHAHNVVAHDPFSFEHKSLNTIEKEWKEWKRTDHSLYVAPIVGTVGSFLLKKVGSLVGKRILSELQNLIFPSGSIDLMQEILRATEQFINQRLNADTLGRVNAELAGLQANVAEFNRQVDNFLNPNQNPVPLAIIDSVNTLQQLFLSRLPQFQIQGYQLLLLPLFAQAANLHLSFIRDVILNADEWGISAATVRTYRDHLRNFTRDYSNYCINTYQTAFRGLNTRLHDMLEFRTYMFLNVFEYVSIWSLFKYQSLLVSSGANLYASGSGPTQSFTAQNWPFLYSLFQVNSNYVLNGLSGARTTITFPNIGGLPGSTTTQTLHFARINYRGGVSSSRIGQANLNQNFNISTLFNPLQTPFIRSWLDSGTDREGVATSTNWQSGAFETTLLRFSIFSARGNSNFFPDYFIRNISGVVGTISNADLARPLHFNEIRDIGTTAVASLVTVHNRKNNIYDTHENGTMIHLAPNDYTGFTVSPIHATQVNNQIRTFISEKYGNQGDSLRFELSNTTARYTLRGNGNSYNLYLRVSSIGSSTIRVTINGRVYTANVNTTTNNDGVLDNGARFSDINIGNVVASANTNVPLDIQVTFNGNPQFELMNIMFVPTNLPPLY

SEQ ID NO: 288 - protein, 623 aa, Bacillus thuringiensis SBSBT-1
MNTVLNNGRNTTCHAHNVVAHDPFSFEHKSLNTIEKEWKEWKRTDHSLYVAPIVGTVGSFLLKKVGSLVGKRILSELQNLIFPGGSIDLMQEILRATEQFINQRLNADTLGRVNAELAGLQANVAEFNRQVDNFLNPNQNPVPLAIIDSVNTLQQLFLSRLPQFQIQGYQLLLLPLFAQAANLHLSFIRDVILNADEWGISAATVRTYRDHLRNFTRDYSNYCINTYQTAFRGLNTRLHDMLEFRTYMFLNVFEYVSIWSLFKYQSLLVSSGANLYASGSGPTQSFTAQNWPFLYSLFQVNSNYVLNGLSGARTTITFPNIGGLPGSTTTQTLHFARINYRGGVSSSRIGQANLNQNFNISTLFNPLQTPFIRSWLDSGTDREGVATSTNWQSGAFETTLLRFSIFSARGNSNFFPDYFIRNISGVVGTISNADLARPLHFNEIRDIGTTAVASLVTVHNRKNNIYDTHENGTMIHLAPNDYTGFTVSPIHATQVNNQIRTFISEKYGNQGDSLRFELSNTTARYTLRGNGNSYNLYLRVSSIGSSTIRVTINGRVYTANVNTTTNNDGVLDNGARFSDINIGNVVASANTNVPLDIQVTFNGNPQFELMNIMFVPTNLPPLY

SEQ ID NO: 289 - protein, 623 aa, Bacillus thuringiensis CMBL-BT1
MNTVLNNGRNTTCHAHNVVAHDPFSFEHKSLNTIEKEWKEWKRTDHSLYVAPIVGTVGSFLLKKVGSLVGKRILSELQNLIFPSGSIDLMQEILRATEQFINQRLNADTLGRVNAELAGLQANVAEFNRQVDNFLNPNQNPVPLAIIDSVNTLQQLFLSRLPQFQIQGYQLLLLPLFAQAANLHLSFIRDVILNADEWGISAATVRTYRDHLRNFTRDYSNYCIDTYQTAFRGLNTRLHDMLEFRTYMFLNVFEYVSIWSLFKYQSLLVSSGANLYASGSGPTQSFTAQNWPFLYSLFQVNSNYVLNGLSGARTTITFPNIGGLPGSTTTQTLHFARINYRGGVSSSRIGQANLNQNFNISTLFNPLQTPFIRSWLDSGTDREGVATSTNWQSGAFETTLLRFSIFSARGNSNFFPDYFIRNISGVVGTISNADLARPLHFNEIRDIGTTAVASLVTVHNRKNNIYDTHENGTMIHLAPNDYTGFTVSPIHATQVNNQIRTFISEKYGNQGDSLRFELSNTTARYTLRGNGNSYNLYLRVSSIGSSTIRVTINGRVYTANVNTTTNNDGVLDNGARFSDINIGNVVASANTNVPLDIQVTFNGNPQFELMNIMFVPTNLPPLY

SEQ ID NO: 290 - protein, 623 aa, Bacillus thuringiensis CMBL-BT2
MNTVLNNGRNTTCHAHNVVAHDPFSFEHKSLNTIEKEWKEWKRTDHSLYVAPIVGTVGSFLLKKVGSLVGKRILSELQNLIFPSGSIDLMQEILRATEQFINQRLNADTLGRVNAELAGLQANVAEFNRQVDNFLNPNQNPVPLAIIDSVNTLQQLFLSRLPQFQIQGYQLLLLPLFAQAANLHLSFIRDVILNADEWGISAATVRTYRDHLRNFTRDYSNYCINTYQTAFRGLNTRLHDMLEFRTYMFLNVFEYVSIWSLFKYQSLLVSSGANLYASGSGPTQSFTAQNWPFLYSLFQVNSNYVLNGLSGARTTITFPNIGGLPGSTTTQTLHFARINYRGGVSSSRIGQANLNQNFNISTLFNPLQTPFIRSWLDSGTDREGVATSTNWQSGAFETTLLRFSIFSARGNSNFFPDYFIRNISGVVGTISNADLARPLHFNEIRDIGTTAVASLVTVHNRKNNIYDTHENGTMIHLAPNDYTGFTVSPIHATQVNNQIRTFISEKYGNQGDSLRFELSNTTARYTLRGNGNSYNLYLRVSSIGSSTIRVTINGRVYTANVNTTTNNDGVLDNGARFSDINIGNVVASANTNVPLDIQVTFNGNPQFEFMNIMFVPTNLPPLY

SEQ ID NO: 291 - protein, 633 aa, Bacillus thuringiensis BR30
MNSVLNSGRNTICDAYNVVVHDPFSFQHKSLDTIQKEWMEWKKDNHSLYVDPIVGTVASFLLKKLGSLIGKRILSELRNLIFPSGSTNLMEDILRETEKFLNQKLNTDTLSRVNAELTGLQANVEEFNRQVDNFLNPNRNAVPLSITSSVNTMQQLFLNRLSQFQMQGYQLLLLPLFAQAANLHLSFIRDVILNAEEWGISAATLRTYQNHLRNYTRDYSNYCIDTYQTAFRGLNTRLHDMLEFRTYMFLNVFEYVSIWSLFKYQSLLVSSGANLYASGSGPQQTQLFTSQDWPFLYSLFQVNSNYVLSGFSGASLFTTFPNIGGLPGSTTTQALLAARVNYSGGITSGSIGGSNFNQNFNCNTISPPLSTSFVRSWLDSGSDRQGVNTVTNWQTESFETTSGLRCGAFTPRGNSNYYPGYFIRNISGVSLVLRNEDLKRPLYYNEKRNIESPSGTPGGARAYMVSVHNKKNNIYAVHENGTMIHLAPEDNTGFTISPIHATQVNNQTRTFISEKFGNQGDSLRFEQSNTTARYTLRGNGNSYNLYLRVSSIGNSTIRVTINGRVYTASNVNTTTNNDGVNDNGARFSDINIGNVVASSNSDVPLDINVTLNSGTQFDLMNIMLVPTNISPLY

SEQ ID NO: 292 - protein, 633 aa, Bacillus thuringiensis WB10
MNSVLNSGRTTICDAYNVVVHDPFSFQHKSLDTIQKEWMEWKKDNHSLYVDPIVGTVASFLLKKLGSLIGKRILSELRNLIFPSGSTNLMEDILRETEKFLNQKLNTDTLSRVNAELTGLQANVEEFNRQVDNFLNPNRNAVPLSITSSVNTMQQLFLNRLSQFQMQGYQLLLLPLFAQAANLHLSFIRDVILNAEEWGISAATLRTYQNHLRNYTRDYSNYCIDTYQTAFRGLNTRLHDMLEFRTYMFLNVFEYVSIWSLFKYQSLLVSSGANLYASGSGPQQTQLFTSQDWPFLYSLFQVNSNYVLSGFSGASLFTTFPNIGGLPGSTTTQALLAARVNYSGGITSGSIGGPNFNQNFNCNTISPPLSTSFVRSWLDSGSDRQGVNTVTNWQTESFETTSGLRCGAFTPRGNSNYYPGYFIRNISGVSLVLRNEDLKRPLYYNEKRNIESPSGTPGGARAYMVSVHNKKNNIYAVHENGTMIHLAPEDNTGFTISPIHATQVNNQTRTFISEKFGNQGDSLRFEQSNTTARYTLRGNGNSYNLYLRVSSIGNSTIRVTINGRVYTASNVNTTTNNDGVNDNGARFSDINIGNVVASSNSDVPLDINVTLNSGTQFDLMNIMLVPTNLPPLY

SEQ ID NO: 293 - protein, 633 aa, Bacillus thuringiensis 5_2AcT(1)
MNTVLNNGRNTICDAYNVVVHDPFSFQHKSLDTIQKEWMEWKKDIHSLYVDPIVGTVASFLLKKLGSLIGKRILSELRNLIFPSGSTNLMEDILRETEKLLNQKLNTDTLSRVNAELTGLQANVEEFNRQVDNFLNPNRNAVPLSITSSVNTMQQLFLNRLSQFQMQGYQLLLLPLFAQAANLHLSFIRDVILNAEEWGISAATLRTYQNHLRNYTRDYSNYCIDTYQTAFRGLNTRLHDMLEFRTYMFLNVFEYVSIWSLFKYQSLLVSSGANLYASGSGPQQTQLFTSQDWPFLYSLFQVNSNYVLSGFSGASLFTTFPNIGGLPGSTTTQALLAARVNYSGGITSGSIGGSNFNQNFNCNTISPPLPTSFVRGWLDSGSDRQGVNTVTNWQTESFEATSGLRCGAFTPRGNSNYYPGYFIRNISGVSLVLRNEDLKRPLYYNEKRNIESPSGTPGGARAYMVSVHNKKNNIYAVHENGTMIHLAPEDNTGFTISPIHATQVNNQTRTFISEKFGNQGDSLRFEQSNTTARYTLRGNGNSYNLYLRVSSIGNSTIRVTINGRVYTASNVNTTTNNDGVNDNGARFSDINIGNVVASSNSDVPLDINVTLNSGTQFDLMNIMLVPTNLPPLY

SEQ ID NO: 294 - protein, 633 aa, Bacillus thuringiensis CMBL-BT2
MNTVLNNGRNTICDAYNVVVHDPFSFQHKSLDTIQKEWMEWKKDNHSLYVDPIVGTVASFLLKKLGSLIGKRILSELRNLIFPSGSTNLMEDILRETEKFLNQKLNTDTLSRVNAELTGLQANVEEFNRQVDNFLNPNRNAVPLSITSSVNTMQQLFLNRLSQFQMQGYQLLLLPLFAQAANLHLSFIRDVILNAEEWGISAATLRTYQNHLRNYTRDYSNYCIDTYQTAFRGLNTRLHDMLEFRTYMFLNVFEYVSIWSLFKYQSLLVSSGANLYASGSGPQQTQLFTSQDWPFLYSLFQVNSNYVLSGFSGASLFTTFPNIGGLPGSTTTQALLAARVNYSGGITSGSIGGSNFNQNFNCNTISPPLSTSFVRSWLDSGSDRQGVNTVTNWQTESFETTSGLRCGAFTPRGNSNYYPGYFIRNISGVSLVLRNEDLKRPLYYNEKRNIESPSGTPGGARAYMVSVHNKKNNIYAVHENGTMIHLAPEDNTGFTISPIHATQVNNQTRTFISEKFGNQGDSLRFEQSNTTARYTLRGNGNSYNLYLRVSSIGNSTIRVTINGRVYTASNVNTTTNNDGVNDNGARFSDINIGNVVASSNSDVPLDINVTLNSGTQFDLMNIMLVPTNLPPLY

SEQ ID NO: 295 - protein, 633 aa, Bacillus thuringiensis HD29
MNSVLNSGRTTICDAYNVAAHDPFSFQHKSLDTVQKEWTEWKKNNHSLYLDPIVGTVASFLLKKVGSLVGKRILSELRNLIFPSGSTNLMQDILRETEKFLNQRLNTDTVARVNAELTGLQANVEEFNRQVDNFLNPNRSAVPLSITSSVNTMQQLFLNRLPQFQMQGYQLLLLPLFAQAANLHLSFIRDVILNAEEWGISAATLRTYRDYLKNYTRDYSNYCIDTYQTAFRGLNTRLHDMLEFRTYMSLNVFEYVSIWSLFKYQSLLVSSGANLYASGSGPQQTQLFTSQDWPFLYSLFQVNSNYVLSGFSGASLFTTFPNIGGLPGSTTTQALLAARVNYSGGITSGSIGGSNFNQNFNCNTISPPLSTSFVRSWLDSGSDRQGVNTATNWQTESFETTSGLRCGAFTPRGNSNYYPGYFIRNISGVSLVLRNEDLKRPLYYNEKRNIESPSGTPGGARAYMVSVHNKKNNIYAVHENGTTIHLAPEDNTGFTISPIHATQVNNQTRTFISEKFGNQGDSLRFEQSNTTARYTLRGNGNSYNLYLRVSSIGNSTIRVTINGRVYTASNVNTTTNNDGVNDNGARFSDINIGNVVASSNSDVPLDINVTLNSGTQFDLMNIMLVPTNISPLY

SEQ ID NO: 296 - protein, 632 aa, Bacillus thuringiensis
MNNVLNNGRTTICDAYNVVAHDPFSFEHKSLDTIRKEWMEWKRTDHSLYVAPIVGTVSSFLLKKVGSLIGKRILSELWGLIFPSGSTNLMQDILRETEQFLNQRLNTDTLARVNAELEGLQANIREFNQQVDNFLNPTQNPVPLSITSSVNTMQQLFLNRLPQFRVQGYQLLLLPLFAQAANMHLSFIRDVVLNADEWGISAATLRTYQNYLKNYTTEYSNYCINTYQTAFRGLNTRLHDMLEFRTYMFLNVFEYVSIWSLFKYQSLLVSSGANLYASGSGPQQTQSFTSQDWPFLYSLFQVNSNYVLNGFSGARLTQTFPNIGGLPGTTTTHALLAARVNYSGGVSSGDIGAVFNQNFSCSTFLPPLLTPFVRSWLDSGSDRGGVNTVTNWQTESFESTLGLRCGAFTARGNSNYFPDYFIRNISGVPLVVRNEDLRRPLHYNEIRNIESPSGTPGGLRAYMVSVHNRKNNIYAVHENGTMIHLAPEDYTGFTISPIHATQVNNQTRTFISEKFGNQGDSLRFEQSNTTARYTLRGNGNSYNLYLRVSSLGNSTIRVTINGRVYTASNVNTTTNNDGVNDNGARFLDINMGNVVASDNTNVPLDINVTFNSGTQFELMNIMFVPTNLPPIY

SEQ ID NO: 297 - protein, 626 aa, Bacillus thuringiensis C81
MNSVLNSGRTTICDAYNVVAHDPFSFQHKSLDTIQKEWTEWKKNNHSLYVDPIVGTVGSFLLKKVGSLIGKRILSELLNLIFPSGNTNLMQDILRETEKLLNQRLNADTLNRVNAELRGLEANVNEFNRQVDNFLNPNRNAVPLSITSSVNTMQQLFLSRLPQFQIQGYQLLLLPLFAQAANLHLSFIRDVILNADEWGISAATLRTYRDHLRNYTRDYSNYCINTYQTAFRGLNTRLHDMLEFRTYMFLNVLDYVSIWSLFKYQSLLVSSGANLYACGNSPNTQSFTAQDWPFLYSLFQVNSNYILSGLSGSRSTITLPVIGPFPGTTTTQTLHNARINYRGGISSGLIGSSNLNQNFNITPIFNPLLTPFIRSWLDSGIDREGLATTTNWMTGSFETTIGLRFSIFTARGNSNYFPDYFIRNISGVVRDLRNEDLRKPLHFNEIRNIGTTPVSSLVSVHNRKNNIYAVHENGSMIHLMPKDYTGFTISPIHATHVNNQNRTFISEKFGNQGDSLRFEQSNTTARYTFRGNGNSYNLYLRVSSLGNSTIRVTINGRVYTATNVNTTTNNDGVNDNGAHFSDINIGNVVASSNTDVPLDINVTFNSGAQFDLMNIMLVPTNISPLY

SEQ ID NO: 298 - protein, 626 aa, Bacillus thuringiensis SK-758
MNSVLNSGRTTICDAYNVVAHDPFSFQHKSLDTIQKEWTEWKKNNHSLYVDPIVGTVGSFLLKKVGSLIGKRILSELLNLIFPSGDTNLMQDILRETEKLLNQRLNADTLNRVNAELRGLEANVNEFNRQVDNFLNPNRDAVPLSITSSVNTMQQLFLSRLPQFQIQGYQLLLLPLFAQAANLHLSFIRDVILNADEWGISAATLRTYRDHLRNYTRDYSNYCINTYQTAFRGLNTRLHDMLEFRTYMFLNVLDYVSIWSLFKYQSLLVSSGANLYACGNSPNTQSFTAQDWPFLYSLFQVNSNYILSGLSGSRSTITLPVIGPFPGTTTTQTLHNARINYRGGISSGLIGSSNLNQNFNITPIFNPLLTPFIRSWLDSGIDREGLATTTNWMTGSFETTIGLRFSIFTARGNSNYFPDYFIRNISGVVRDLRNEDLRKPLHFNEIRNIGTTPVSSLVSVHNRKNNIYAVHENGSMIHLMPKDYTGFTISPIHATHVNNQNRTFISEKFGNQGDSLRFEQSNTTARYTFRGNGNSYNLYLRVSSLGNSTIRVTINGRVYTATNVNTTTNNDGVNDNGAHFSDINIGNVVASSNTDVPLDINVTFNSGAQFDLMNIMLVPTNISPLY

SEQ ID NO: 299 - protein, 634 aa, Bacillus thuringiensis JF19-2
MNSVLNTGRTTICDAYNVAAHDPFSFQHKSLDTVQKEWTEWKKNNHSLYLDPIVGTVASFLLKKVGSLVGKRILSELRNLIFPSGSTNLMQDILRRDTKNSCIKDLIQTLLPVYMRNWHGLQADVEEFNRQVDNSLNPNRNAVPLSITSSVNTLQHLFLNRLPQFQLQGYQLLLLPLFAQAANLHLSFIRDVILNADEWGISAATLRTYRDYLKNYTRDYSNYCINTYQSAFKGLNTRLHDLLEFRTYLFLNVFEYVSIWSLFKYQSLLVSSGANLSASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDRERVATVTNWRTESFETTLGLRSGAFTARGNSNYYSDYFIRNISGVPLVVRNEDLRRPLHYNEIRNIASPSGTPGGARAYLVSVHNRKNNIHAVHENGSLIHLAPTDYTGFTISPIHATQANNQTRTFISEKFGNQGDSLRFEQNNTTARYTLRGNGNSYNLYLRVSSIGNSTIRVTINGRVYTATTVNTTTNNDGVNDNGARSSNINIGNVVASSNPDVPLDINVTLNSGTQFDLMNTMLVPTNISPLY

SEQ ID NO: 300 - protein, 632 aa, Bacillus thuringiensis SC6H8
MNNVLNSGRATNGDAYNVVAHDPFSFQHKSLDTIQEEWMEWKKDNHILYVDPIVGTVASFLLKKVGSLVEKRILSELRNLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYQNHLRNYTREYSNYCITTYQTAFRGLNTRLHDMLEFRTYMFLNVFEYVSIWSLFKYQSLLVSSGANLYASGSGPQQTQSFTSQDWPFLYSLFQVNSNYVLNGFSGARLTQTFPNIVGLPGTTTTHALLAARVNYSGGVSSGDIGAVFNQNFSCSTFLPPLLTPFVRSWLDSGSDRGGINTVTNWQTESFETTLGLRSGAFTARGNSNYFPDYFIRNISGVPLVVRNEDLRRPLHYNQIRNIESPSGTPGGLRAYMVSVHNRKNNIYAVHENGTMIHLAPEDYTGFTISPIHATQVNNQTRTFISEKFGNQGDSLRFEQSNTTARYTLRGNGNSYNLYLRVSSIGNSTIRVTINGRVYTASNVNTTTNNDGVNDNGARFSDINIGNVVASDNTNVPLDINVTLNSGTQFELMNIMFVPTNLPPLY

SEQ ID NO: 301 - protein, 632 aa, Bacillus thuringiensis BRC-ZQL3
MNSVLNSGRTTICDAYNVAAHDPFSFQHKSLDTVQKEWTEWKKNNHSLYLDPIVGTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDMLEFRTYMFLNVFEYVSIWSLFKYQSLLVSSGANLYASGSGPQQTQSFTSQDWPFLYSLFQVNSNYVLNGFSGARLTQTFPNIVGLPGTTTTHALLAARVNYSGGVSSGDIGAVFNQNFSCSTFLPPLLTPFVRSWLDSGSDRGGINTVTNWQTESFETTLGLRSGAFTARGNSNYFPDYFIRNISGVPLVVRNEDLRRPLHYNQIRNIESPSGTPGGLRAYMVSVHNRKNNIYAVHENGTMIHLAPEDYTGFTISPIHATQVNNQTRTFISEKFGNQGDSLRFEQSNTTARYTLRGNGNSYNLYLRVSSIGNSTIRVTINGRVYTASNVNTTTNNDGVNDNGARFSDINIGNVVASDNTNVPLDINVTLNSGTQFELMNIMFVPTNISPLY

SEQ ID NO: 302 - protein, 688 aa, Bacillus thuringiensis medellin
MNSYENKNEYEILDTSQKNSNMSNRYSKYPLTNNPKVPLQNTNYKDWLNMCQTITPLCTPIDTDSKLVATAIKVIGAIFKSMPGPGAAVGLVLKSFSTIIPILWPNDKTPIWKEFTKQGLQLFRPELGRDAIEIIGNDVQAEYNSLEIMMRDFENKFANWESNRTRANAIAVTTAFSTVNTQIIRLKERFLIAPENRPAFLNLYAQTANIDLILYQRGSVYGDKWVADINNRSTSPFSSKDYYQSLKGKIKDYTNYCAETYRNSLTILKNKPHIQWDIYNRYRREAILGALDLVALFPNYDICIYPTQTRTELTRKVYMPSFYLQALQQRDIETVENQLTHPPSLFTWLNELNLYTIRERFNPVLQVASLSGLQATSRYTQNTTTISNPVQGPVREGTPTKISLANYYIYKLFMSQYRHPNDCLPISGINEMSFYRSDYYGAGGPAPVHYSAGESPTNVIKTYMNGPQNALISNDISINETSHILSDIKMNYSRTGGVYPLYDFGYSFAWTHTSVDPDNLIVPNRITQIPAVKAYSLTSPARVIVGPGHTGGDLVALLNSGTQSGTMQIQCKTGSFTGPSRQYGLRMRYAANSAFTVSLSYTLLGQTRGTSFVTENTFSRSNNIIPTDLKYEEFKYKDYLQIITMTLPANTIITISMQQATGLLNNQLIIDRIEFYPMDQGVVACTVN

SEQ ID NO: 303 - protein, 683 aa, Bacillus thuringiensis entomocidus
MNPYQKKTEYEILDALPNYSNMVNAYSRYPLANNPQVPLQNTSYKDWLNMCQTINPLCTPINIDIDSLAASIAVVGSILALIPGPGEAIGFVLGTFSTILPILWPNGETKIWTDFAERGLQLFRPELGQDAIEILVTGVKSGYNALKNRMENFEQAFTKWKGNRTRSNAEQVIRDFDSVRDKVIDLKNDYMINPENKPAFINLYAQTANIDLILYQRGAVYGDDWEKDINGSISPFWGSKDYYESLKTKIEEYTNYCAETYRNSLNILKNKPNISWDTYNKYRREATLGALDLVALFPNYDMHLYPAATKTELTRKIYMPSFGLQQSNYFQSLEGLENALTHPPSLFTWLNELNLYTVRENFNPALQVSSLSGLQARSRYTQNPTILDNPAQGVRNGTSTQIGLNNLFVYKLSMSQYHHPNDCSSIAGISDMTFYKSDYNGNASATQTYQAGRNTNNVINTFMNGPQKASSSNNISIKQTKHILSDIKMIYFRTGGMYQVYDFGYSFAWTHTSVDPDNLIVPNRITQIPAVKALGISTDSKVVKGPVFIGGDLLLLKLQATIRIKTDHANTRYKIRVRYASNANTPIVLSSLQNTLTVTFPQTITHSTISELQYKDFQYVTFPGEFIMDKPSIDVAIRGVQNDRNDIWIDRIEFLPITQSVLDYTEEQNIEKSQKAVNDLFIN

SEQ ID NO: 304 - protein, 688 aa, Bacillus thuringiensis sotto
MNLYGNKNDSEILNASSNNSNMSTTYPKYPLAHSRQDSMENMNYKEWINQCETINTFCTPIDTDINSVAATIGAVGAILALIPGPGEAIGFVLSTFTSLIPYLWPSDTKKIWGDFTKQGLQLFRPELGNDAIEIIGNDVQSEYNSLKTFMQNFEDSFTDWKKYRNRATAVAVTNDFSSVRDQIIRLKDRFLINPENKPAFLILYAQTANFDLILYQRGALYADEWENDINRSISPLLGSKDYYISLAAKIKEYTNYCAETYRNSLNILKNKTNISWGTYNKYRREVTLGALDLAALFPNYDICIYPIQTKTELTRKVYMPSFGLQQSNYFQSLEGLENALTHPPSLFTWLNELNLYTIRENFNPALLVSSLSGLQAISRYTQNPNRISNPAQGVRNGTPTQIGLNNLFVYKLSLSQYHHPNECYSIAGISDMTFYKSDYNGNAPTTQTYQAGRNSNNFINTFMNGPQEASSSNNISIKQTNHILSDIKMIYSRTGGTYPSYDFGYSFAWTHTSVNPDNLIVPNRITQIPAVKADYLTSPAKVIAGPGHTGGDLVALLNAATQAGRMQIQCKTGSFTGASRRYGIRIRYAANNALTVSLSYTVQGGNTMSTTFITERTFLRPNNTIPTDLKYEEFKYKEYNQIITMTAPQNTIVTIAIQQLNAFPNDQLIIDRIEFYPMDQGVVPCTVN

SEQ ID NO: 305 - protein, 688 aa, Bacillus thuringiensis jegathesan 367
MNLYGNKNDSEILNASSNNSNMSTTYPKYPLAHSRQDSMQNMNYKEWINQCETINTFCTPINIDINSVAATIGAVGAILALIPGPGEAIGFVLSTFTSLIPYLWPSDTKKIWGDFTKQGLQLFRPELGNDAIEILGNDVQSEYNSLKTFMQNFEKSFAAWKIKRDRATAVAVTNDFSSVRDQIIRLKDRFLINPENKPAFLILYAQTANFDLILYQRGALYADEWENDINRSISPLLGSKDYYISLAAKIKEYTNYCAETYRNSLDILKNKPNISWDTYNKYRREVTLGALDLAALFPNYDICIYPIQTKTELTRRVYMPSFGLQQSNYFQSLEGLENALTHPPSLFTWLNELNLYTIRENFNPALLVSSLSGLQAISRYTQNPNRISNPDQGVRTGTPTQIGLNNLFVYKLSLSQYHHPNECYSIAGISDMTFYKSDYNGNAPTTQTYQAGRNSNNFINTFMNGPQEASSSNNISIKQTNHILSDIKMIYSRTGGTYPSSDFGYSFAWTHTSVNPDNLIVPNRITQIPAVKADYLTSPAKVIAGPGHTGGDLVALLNAATQAGRMQIQCKTGSFTGASRRYGIRIRYAANNALTVSLSYTVQGGNTMGTTFITERTFLRPNNTIPTDLKYEEFKYKEYNQIITMTAPQNTIVTIAIQQLNAFPNDQLIIDRIEFYPMDQGVVPCTVN

SEQ ID NO: 306 - protein, 684 aa, Bacillus thuringiensis Y41
MNPYQNTNECEILDDLPNYSKMVNAYSRYPLANNPEVPLQNTSYKDWLNMCQTITPLCTPIDSDINSIAAAIGVIGSILGLIPGPGEAIGLILGTFSSIIPFLWPENKSIIWEEFTHRGLHLIRPELTPTEIEIIVTPLKGYYNALREQLENFESEFAKWALEKSPANTRDVVLRFSAIDAAIINLKNQLIVDVRNKPAFLSLYAQTANIDLILFQRGDKYGDEWVKYARNQPIPFKTSQEYYNSLKDKIENYTNDIAETYRNGLNIIKNIPKISWDVFNLYRREMTLSALDLVALFLNYDIYRYPISTKTELTRKVYMSSFYLQALEQNESLESLENKPLPHSPSLFTWLKRLNLYTISEDYSIPLRVSSLSGLSAVYSHTHQQQALYTRPYQGVLVGQPQEIRFDGFVYKLFMSQNISPNSCYLIGGIPQMSFYISDYSGGLRPNKDYYSASASIYFINSYMNGPQNATKSNNISIRETKHILSDIKMNYSKTGGFYPFHTFGYSFAWTHTSVDPDNLIVPNRITQIPAVKAHYLSATAKVIAGPGHTGGDLVALINDGSRTGSMNIECKTGSFTQPSRRFGLRMRYAENNQFSVSILRDNQGVGTFNIERTFSRTNNIIPTDLKYNEFKYNNYDEITMDLPPNKIIDIRIQQTNSLSINQFIIDRIEFYPIDQGVEACKMQ

SEQ ID NO: 307 - protein, 684 aa, Bacillus thuringiensis aizawai BUN1-14
MNPYQNTNECEILDASPNYSKMGNAYSRYPLANNPQVPLQNTSYKDWLNMCQTITPLCTPIDPDINSVAAAIGVIGSIIGLIPGPGEAIGLILGTFSSIIPFLWPENKTIIWEEFTHRGLHLIRPELTPTEIEIIVNPLKGYYNALREQLENFESEFAIWARNKNAATTGDVLRRFSNIDADIIRLKHQLTVDVRNKPALLSLYAQTANIDLILFQRGAKYGDEWARYARNQPIPFKTSQEYYDSLKEKIENYTNDIAATYRNGLNIIKNIPKISWDVFNLYRREMTLSALDLVALFPNYDICRYPISTKTELTRKVYMSSFYLQALELNESLESLENKLTHPPSLFTWLKRLNLYTISENYSSPLRVSSLSGLSAVYSHTHQQQALYVGPPQGITGGSPQEIRFDGFVYKLFMSQNISPNGCYPIGGIPQMSFYISDYSGSPRPNKDYYSASAIQYISINSYMNGPQNATKSNNISIRETKHILSDIKMNYSQTGGFYPFHSFGYSFAWTHTSVDPDNLIVPNRITQIPAVKAHILSTTAKVIAGPGHTGGDLVALLNDDPRIGTMSIECKTGSFTQPSRRYGLRMRYAANNQFSVSISRNDQGVASFVTERTFSRTNNIIPTDLKYNEFKYNNYDQIIMDLPPNTIINIGIRQTNALSINQFIIDRIEFYPMDQGVEACKMQ

SEQ ID NO: 308 - protein, 688 aa, Bacillus thuringiensis S2160-1
MNSYQNTNEYEILDASQKNSTMSNRYPRCPLANNPQVPLQNTSYKDWLNMCQTITPLCTPVETVSDYVAAFIGVPGSIFGAMPGPGAAVGLFLSSFSTIIPILWPNDTTPIWKEFTKQGLQLFRPELGRDAIEIIGNDVQAEYNALKTMMQDFETKFATWDLNRTRANAIAATTEFNSVKNQIIRLQERFLIAAENRPAFLNLYAQTANIDLILYQRGAANGDKWLEDINNRSISPFSSKDYYQDLKLKIKNYTNYCAETYRNSLNILKNKSDIQWSIYNGYRRVATLGALDLVALFPNYDICIYPIQTQTELTRKVYMPSFYSERLPKGNIETWENSLTHPPSLFTWLKKLDPYTKSERFNPALEVASLCGLHAALSYTPQNGPEFAGPFQGILGTKTTPLISFDNQFVYELFLTQYRHPNDCYSISGKPKITFYISDYYGNSRPNKEYSSNIQLSSVITSYMNGPQNASTSNNISIKQTKHILSDIKMIYTQIGGIYPSHDFGYSFAWTHTSVDPDNLIVPNRITQIPAVKAYSLTSPARVIAGPGHTGGDLVALLNNNLEAGRMQIQCKTGSFTGASRRYGLRMRYAANSQFTVNLSYVLSGTTYGTSFITESTFSRLNNIIPTDLKYEEFKYKEYSQIITMTLPANTIITISIQQAVASSNYQLIIDRIELYPMDQDVVACTVN

SEQ ID NO: 309 - protein, 688 aa, Bacillus thuringiensis Ywc2-8
MNSYQNTNEYEILDASQKNSTMSNRYPRCPLANNPQVPLQNTSYKDWLNMCQTITPLCTPVETDSDYVAAFIGVLGSIFGAMPGPGAAVGLFLSSFSTIIPILWPNDTTPIWKEFTKQGLQLFRPELGRDAIEIIGNDVQAEYNALKTMMQDFETKFATWDLNRTRANAIAVTTEFNSVKNQIIRLQERFLIAAENRPAFLNLYAQTANIDLILYQRGAANGDKWLEDINNRSISPFSSKDYYQDLKLKIKNYTNYCAETYRNSLNILKNKSDIQWSIYNGYRRVATLGALDLVALFPNYDICIYPIQTQTELTRKVYMPSFYSERLPKGNIETWENSLTHPPSLFTWLKKLDPYTKSERFNPALEVASLCGLHAALSYTPQNGPEFAGPFQGILGTKTTPLISFDNQFVYKLFLTQYRHPNDCYSISGIPKITFYISDYYGNSRPNKEYSSNIQLSSVITSYMNGPQNASTSNNISIKQTKHILSDIKIIYTQIGGIYPSHDFGYSFAWTHTSVDPDNLIVPNRITQIPAVKAYSLTSPARVIAGPGHTGGDLVALLNNNLEAGRMQIQCKTGSLTGASRRYGLRMRYAANSQFTVNLSYVLSGTTYGTSFITESTFSRLNNIIPTDLKYEEFKYKEYSQIITMTLPANTIITISIQQAVASSNYQLIIDRIEFYPMDQGVVACTVN

SEQ ID NO: 310 - protein, 687 aa, Bacillus thuringiensis MC28
MKPYQSENEYEILDTLPKYSNIVNVYSRYPLANNPQVPLQNTSYKDWLNMCQTITPLCTPIDIDSKLVATAIGILGAIFKAMPGPGSAVGLFLKTFSTIIPILWPNDNTPIWKEFTKQGLQLFRPELGRDAIEIIGNDVQSGFNALKDHMNDFETKFEIWDKDRTQTNATYLITAFGVVNGKIIDLKNQFLINPANQPAFLNLYAQTANIDLILYQRGAVYGDDWAKAINDSSISPFNSSQIFYDSLKAKIKEYTNYCAETYRNSLTILKNQPNIQWDIYNRYRREATLGALDLVALFPNYDICKYPISTKTELTRKVYMPSFYLQALQHSNIETLENQLTHPPSLFTWLNELNLYTIRENFNPALQVSSLSGLQAKYRYTQNSTILPNPPAQGITNGTPIPIIGLNNLFIYKLSMSQYRHPNDCVPIAGISDMTFYKSDYNGNASATQTYQAGRNSNNVIDTFMNGPQNASSSNNISINQTNHILSDIKMNYARSGGVYDFGYSFAWTHTSVDLDNLIVPNRITQIPAVKANFLSSPARVIAGPGHTGGDLVALLNGGTQAGKMQIQCKTGSSTGASRRYGIRMRYAANNAFTVSLSYTLQGGNTIGTTFITERTFSRPNNIIPTDLKYEEFKYKEYNQIITVTSPQNTIVTIAIRQLNPIPNDQLIIDRIEFYPVDQDAFACPVN

SEQ ID NO: 311 - protein, 664 aa, Bacillus thuringiensis HS18-1
MNLYQNENEYKILDVLPNYSNMVNAYSSYPLANNPQVPLQNTSYKDWLNMCQTITPLCTTIDSDINSVAAAIGVIASIIGLIRGPGEAIGLILGTFSSIIPFLWPENKTIIWEEFTHRGLNLIRPELTPAEIEIILNPLKGSYNALREQLVNFEREFAIWAGAKNQATTGDLLRRISAIEGAIIQLKNQLTVSEANKPALLSLYAQTANIDLILFQRGAKYGDEWAKYARNQPIPFKTSREYYASLIEKIKTYTNDIAGTYRNGLNKIKNIQNISWDTFNEYRRGMTLSALDLVALFPNYDICIYPIQTKTELTRKIYMPSFYLQALQQSGNLESLENQLTHPPSLFTWLNELNLYTISENFNPAILPNPAQGITGGTPIPIGLNNLFIYKLSMSQYHDPNGCYPIAGISDMTFYKSDYNGNASTTQPYHAGRNSNNVIDTFMNGPQNASSSNNISIKETKHILSDIKMVYSRSGVYSLGYSFAWTCTSVNPDNLIVPNRITQIPAVKANLLNSPARVIAGPGHTGGDLVALLNSGTQSGRMEIKCKTGSFTETSRRYGIRMRYAANNAFTVSLSYTLQGGNPIGITFGTERTFLRTNNIIPTDLKYEEFKYKEYNQIITMTAPQNTIVTIAVYQSTPSLNNQLIIDRIEFYPMDQGVEACKMN

SEQ ID NO: 312 - protein, 664 aa, Bacillus thuringiensis S2160-1
MNLYQNENEYKILDVLPNYSNMVNAYSRYPLANNPQVPLQNTSYKDWLNMCQTITPLCTTIDSDINSVAAAIGVIASIIGLIRGPGEAIGLILGTFSSIIPFLWPENKTIIWEEFTHRGLNLIRPELTPAEIEIILNPLKGSYNALREQLVNFEREFAIWAGAKNQATTGDLLRRISAIEGAIIQLKNQLTVSEANKPALLSLYAQTANIDLILFQRGAKYGDEWAKYARNQPIPFKTSREYYASLTEKIKTYTNDIAGTYRNGLNKIKNIQNISWDTFNEYRREMTLSALDLVALFPNYDICIYPIQTKTELTRKIYMPSFYLQALQQSGNLESLENQLTHPPSLFTWLNELNLYTISENFNPAILPNPAQGITGGTPIPIGLNNLFIYKLSMSQYHDPNGCYPIAGISDMTFYKSDYNGNASTTQPYHAGRNSNNVIDTFMNGPQNASSSNNISIKETKHILSDIKMVYSRSGVYSFGYSFAWTYTSVDPDNLIVPNRITQIPAVKANLLNSPARVIAGPGHTGGDLVALLNSGTQSGRMEIKCKTGSFTGASRRYGIRMRYAANNAFTVSLSYTLQGGNPIGITFGTERTFLRTNNIIPTDLKYEEFKYKEYNQIITMTAPQNTIVTIAVYQSTPSLNNQLIIDRIEFYPMDQGVEACKMN

SEQ ID NO: 313 - protein, 723 aa, Bacillus thuringiensis 84-HS-1-11
MDPFSNYSEQKYPDSNNNQELITKSSSFYSDTTNENAKNYHPIEQDILKFTNQEFSDNHYQHSDVSNDINSMRNTLCKDLPPETNMSIYDNLRSTVTVPSFSNQFDPIKFLHDIEIAIQTGSFSALTQSNMNQGGTDINPMLISTFFKVASSLLPFPLSSLGALASFYVTDSQTGAMANLWRQMVDYVEKRIDSKILDYHNFIMGAELAALNASLKEYARVVKIFENDMNRMAEPPSTGVITQFRILNDNFIKYIAKLQFSTNQSDLQYPVLTLPLRAQACVMHLMLLKDATTSVWGQQIDSQQLNGYKAELIRLIKVYTNDVNTTYNQGLELEKAKPLNYSDPEEYLQAGRPDISVLRSNFKEVMKWNRVAKYKRGMAMSALSLAALFPTFGPNYPKQALKVVQSRQIFAPVIGIPGGITSQDHSGTFGSMRFDVKTYDQIDALRRLMELYIQPLKSAYFYIYESDWKVRATYVNDYIGKRGSNTGLAWGMWSSDPSVIYTSALGAAGYAPNVVGVRYSHGGSYTKGMAPPNTNAYAPFEFKYPGYKLHSVSAYGLSKAPDTADSVMFGFRPVLLENEANQLLTDTALQIPAEIGITDVVPAFGRTEEPINGQDAIIIWESFTSGFGFTYTVDSPQKQKYKIIYRIANNLSASTVSLTYNNQTFFTDILNTSLDPNGVRGNYGSYTLVEGPIIEFSQGTNIFKLRSQKGEFAIDSIIFSPVS

SEQ ID NO: 314 - protein, 742 aa, Bacillus thuringiensis M15
MDPFSNYSEQKYPDSNNNQELITESSSFYSDTTNENMKTYHPIEQDILKFANQEFPDNYYQHSDVSNSYQNMKTEIVNTDLPYNTNNINSMRNTLCRDLPPETNMSIYDNLRSTVTVPSFSNQFDPIKFLHDIEIAIETGSFSALTQSNMNQGGTDIAPMLISTFFKVAGSLLPFPLSSLGALASFYVTDSQTGAMANLWRQMVDYVEKRIDSKILDYHNFIMGAELAALNASLKEYARVVKIFENDMNRIAEPPSTGVITQFRILNDNFIKYIAKLQFSTNQSDLQYPVLTLPLRAQACVMHLMLLKDATTSVWGQQIDSQQLNGYKAELIRLIKVYTNDVNTTYNQGLELEKAKPLNYSDPEEYLQAGRPDISVLRSNFKEVMKWNKVAKYKRGMAMSALSLAALFPTFGPNYPKQALKVVQSRQIFAPVIGIPGGITSQDSGPTFGSMRFDVKTYDQIDALRQLMELYIQPLKSAYFWIYESDWKVRATYVNDYIGKRGSNTGAAWHMWSSDPSAIYTSALGAAGYAPNVVGVRYSHGGSYTKGMAPANTNAYAPFEFKYPGYKLHSVSAYGLSKAPDAADSVMFGFRPVLLENEANQLLTDTALQIPAEIGITDVVPAFGRTEEPINGQDAIRIWESFTSGFGFTYTVDSPQKQKYKIIYRIANNLSASTVSLTYNNQTFFTDILNTSLDPNGVRGNYGSYTLVEGPIIEFSQGTNIFKLGSQKGEFAIDSIIFSPVV

SEQ ID NO: 315 - protein, 723 aa, Bacillus thuringiensis B0195; identical to SEQ ID NO: 313

SEQ ID NO: 316 - protein, 723 aa, Bacillus thuringiensis 79-25
MDPFSNYSEQKYPDSNNNQELITKSSSFYSDTTNENAKNYHPIEQDILKFTNQEFSDNHYQHSDVSNDINSMRNTLCKDLPPETNMSIYDNLRSTVTVPSFSNQFDPIKFLHDIEIAIQTGSFSALTQSNMNQGGTDINPMLISTFFKVASSLLPFPLSSLGALASFYVTDSQTGAMANLWRQMVDYVEKRIDSKILDYHNFIMGAELAALNASLKEYARVVKIFENDMNRMAEPPSTGVITQFRILNDNFIKYIAKLQFSTNQSDLQYPVLTLPLRAQACVMHLMLLKDATTSVWGQQIDSQQLNGYKAELIRLIKVYTNDVNTTYNQGLELEKAKPLNYSDPEEYLQAGRPDISVLRSNFKEVMKWNRVAKYKRGMAMSALSLAALFPTFGPNYPKQALKVVQSRQIFAPVIGIPGGITSQDHSGTFGSMRFDVKTYDQIDALRRLMELYIQPLKSAYFYIYESDWKVRATYVNDYIGKRGSNTGLAWGMWSSDPSVIYTSALGAAGYAPNVVGVRYSHGGSYTKGMAPPNTNAYAPFEFKYPGYKLHSVSAYGLSKAPDTADSVMFGFRPVLLENEANQLLTDTALQIPAEIGITDVVPAFGRTEEPINGQDAIIIWESFTSGFGFTYTVDSPQKQKYKIIYRIANNLSASTVSLTYNNQTFFTDILNTSLDPNGVRGNYGSYTLVEGPIMEFSQGTNIFRLRSQKGEFAIDSIIFSPVS

SEQ ID NO: 317 - protein, 723 aa, Bacillus thuringiensis 92-10
MDPFSNYSEQKYPDSNNNQELITKSSSFYSDTTNENAKNYHPIEQDILKFTNQEFSDNHYQHSDVSNDINSMRNTLCKDLPPETNMSIYDNLRSTVTVPSFSNQFDPIKFLHDIEIAIQTGSFSALTQSNMNQGGTDINPMLISTFFKVASSLLPFPLSSLGALASFYVTDSQTGAMANLWRQMVDYVEKRIDSKILDYHNFIMGAELAALNASLKEYARVVKIFENDMNRMAEPPSTGVITQFRILNDNFIKYIAKLQFSTNQSDLQYPVLTLPLRAQACVMHLMLLKDATTSVWGQQIDSQQLNGYKAELIRLIKVYTNDVNTTYNQGLELEKAKPLNYSDPEEYLQAGRPDISILRSNFKEVMKWNRVAKYKRGMAMSALSLAALFPTFGPNYPKQALKVVQSRQIFAPVIGIPGGITSQDHSGTFGSMRFDVKTYDQIDALRRLMELYIQPLKSAYFWIYESDWKVRATYVNDYIGKRGSNTGAAWHMWSSDPSVIYTSALGAAGYAPNVVGVRYSHGGSYTKGMAPPNTNAYAPFEFKYPGYKLHSVSAYGLSKAPDAADSVMFGFRPVLLENEANQLLTDTALQIPAEIGITDVVPAFGRTEEPINGQDAIIIWESFTSGFGFTYTVDSPQKQKYKIIYRIANNLSASTVSLTYNNQTFFTDILNTSLDPNGVRGNYGSYTLVEGPIIEFSQGTNIFKLRSQKGEFAIDSIIFSPVS

SEQ ID NO: 318 - protein, 754 aa, Bacillus thuringiensis M019
MSVVYHVKGGDIVDPFSNYSAQKYPDSNNNQELTTKSSLFYSDTTNGNVKNYHPIEQDILKFTNQEFSDNSYRHSDVSNSYENKKKEIINIDLPYNTNDINSMRNTLCRDLPPETNMSIYDNLRSAVTVPSFSNQFDPIKFLHDIEIAIQTGSFSALTQSNMNQGGTDINPMLISTFFKVASSLLPFPLSSLGALASFYITDSQTGAMANLWRQMVDYVEKRIDSKILDYHNFIMGAELAALNASLKEYARVVKIFENDMNRMAEPPSTGVITQFRILNDNFIKYIAKLQFSTNQSDLQYPVLTLPVRAQACVMHLMLLKDATTSVWGQQIDSQQLNGYKAELIRLIKVYTNDVNTTYNQGLELEKAKPLNYSDPEEYLQAGRPDISVLRSNFREVMKWNRVAKYKRGMAMSALSLAALFPTFGPNYPKQALKVVQSRQIFAPVIGIPGGITSQDSGPTFGSMRFDVKTYDQIDALRQLMELYIQPLKSAYFWIYESDWKVRATYVNDYIGKRGSNTGAAWHMWSSDPSAIYTSALGAAGYAPNVVGVRYSNGGSYTKGMAPANTNAYAPFEFKYPGYKLHSVSAYGLSKAPDAADSVMFGFRPVLLENEANQLLTDTALQIPAEIGITDVVPAFGRTEEPINGQDAIRIWESFTTGLGFTYTVDSPQKQKYKIIYRIANNLSASTVSLTYNNQTFFTDILNTSLDPNGVRGNYGSYTLVEGPIIEFSQGTNIFKLRSQKGEFAIDSIIFSPVV

SEQ ID NO: 319 - protein, 726 aa, Bacillus thuringiensis B0195
MEKFSNFSEQKYPDSNNNQELTVESSSFYSNTINENVKNHHPIEQDILKFTNQEFSDNHYQHSDVSNDINSMRNTLCRDLPPETNMSIYDNLRSTVTVPSFSNQFDPIKFLHDIEIAIQTGSFSALTQSNMNQGGTDINPMLISTFFKVASSLLPFPLSSLGALASFYITDSQTGAMANLWRQMVDYVEKRIDSKILDYHNFIMGAELAALNASLKEYARVVKIFENDMNRMAEPPSTGVITQFRILNDNFIKYIAKLQFSTNQSDLQYPVLTLPLRAQACVMHLMLLKDATTSVWGQQIDSQQLNGYKAELIRLIKVYTNDVKTTYNQGLELEKAKPLNYSDPEEYLQAGRPDISVLRSNFKEVMKWNRVAKYKRGMAMSALSLAALFPTFGPNYPKQALKVVQSRQIFAPVIGIPGGITSQDHSGTFGSMRFDVKTYDQIDALRRLMELYIQPLKSAYFWIYESDWKVRATYVNDYIGKRGSDTGAAWHMWSSDPSVIYTSALGAAGYAPNVVGVRYSHGGSYTKGMAPANTNAYAPFEFKYPGYKLHSVSAYGLSKAPNAADSVMFGFRPVLLENEANQLLTDTALQIPAEITEKIPNVSLDNYLVEETINGQNAIQLWEPTFPGDPKNRFNYTINSPREQNYKIIYRIASNEPAQISLTYNSKFLTDIPNTSLDPNGVKGNYGFYTLIEGPIIRFSSGTNIFSIRSEINTFAIDSIIFSPVS

SEQ ID NO: 320 - protein, 726 aa, Bacillus thuringiensis 31-5
MDPFSNYSEQKYPDSNNNQELTVESSSFYSNTINENVKNHHPIEQDILKFTNQEFSDNHYQHSDVSNDINSMRNTLCRDLPPETNMSIYDNLRSTVTVPSFSNQFDPIKFLHDIEIAIQTGSFSALTQSNMNQGGTDINPMLISTFFKVASSLLPFPLSSLGALASFYITDSQTGAMANLWRQMVDYVEKRIDSKILDYHNFIMGAELAALNASLKEYARVVKIFENDMNRMAEPPSTGVITQFRILNDNFIKYIAKLQFSTNQSDLQYPVLTLPLRAQACVMHLMLLKDATTSVWGQQIDSQQLNGYKAELIRLIKVYTNDVNTTYNQGLELEKAKPLNYSDPEEYLQAGRPDISVLRSNFKEVMKWNRVAKYKRGMAMSALSLAALFPTFGPNYPKQALKVVQSRQIFAPVIGIPGGITSQDHSGTFGSMRFDVKTYDQIDALRRLMELYIQPLKSAYFWIYESDWKVRATYVNDYIGKRGSDTGAAWHMWSSDPSVIYTSALGAAGYAPNVVGVRYSHGGSYTKGMAPANTNAYAPFEFKYPGYKLHSVSAYGLSKAPNAADSVMFGFRPVLLENEANQLLTDTALQIPAEITEKIPNISLDNYLVEETINGQNAIQLLEPTFPGDPKNRFNYTINSPREQNYKIIYRIASNEPAQISLTYNSKFLTDIPNTSLDPNGVKGNYGSYTLIEGPIIRFSSGTNIFSIRSEINTFAIDSIIFSPVS

SEQ ID NO: 321 - protein, 777 aa, Bacillus thuringiensis 87-29
MDPFSSYSEQKYPDSNNNQELITKSSSFYSDTTNENAKNYHPIEQDILKFTNQEFSDNPYQHSDVSNSYENKKKEIINIDLPYNTNDINSMRNTLCRDLPPETNMSIYDNLRSTVTVPSFSNQFDPIKFLHDIEIAIQTGSFSALTQSNMNQGGTDINPMLISAFFKVAGSLLPFPLSSLGALASFYVTDSQTGAMANLWRQMVDYVEKRIDSKILDYHNFIMGAELAALNASLKEYARVVKIFENDMNRIAEPPSTGVITQFRILHDNFIKYIAKLQFSTNQSDLQYPVLTLPLRAQACVMHLMLLKDATTSVWGQQIDSQQLNGYKAELIRLIKVYTNDVNTTYNQGLELEKAKPLNYSDPEEYLQAGRPDISVLRSNFKEVMKWNRVAKYKRGMAMSALSLAALFPTFGPNYPKQALKVVQSRQIFAPVIGIPGGITSQDHSGTFGSMRFDVKTYDQIDALRRLMELYIQPLKSAYFYIYESDWKVRATYVNDYIGKRGSNTGLAWGMWSSDPSVIYTSALGAAGYAPNVVGVRYSHGGSYTKGMAPPNTNAYAPFEFKYPGYKLHSVSAYGLSKAPDAADSVMFGFRPVLLENEANQLLTDTALQIPAEIGITDVVPAFGRTEEPINGQDAIILKKITRGPIPGGSTDCSPWELTHGMCEIDPGPPVPPGPPVPLPHRINYTINSPESGKEYTIWYRLASNQNSLIALQHRISQYDTNISNTQQDTNSVKGNYGYYTLIKGPTLVLFKGENIISLGMLSGEIALDSIIFSPVS

SEQ ID NO: 322 - protein, 633 aa, Bacillus thuringiensis B0462
MNSVLNSGRTTICDAYNVAAHDPFSFQHKSLDTVQKEWTEWKKNNHSLYLDPIVGTVASFLLKKVGSLVGKRILSELRNLIFPSGSTNLMQDILRETEKFLNQRLNTDTVARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDMLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGISNYFPDYFIRNISGVPLVVRNEDLRRPLHYNEIRNIASPSGTPGGARAYMVSVHNRKNNTHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNISPLY

SEQ ID NO: 323 - protein, 758 aa, Bacillus thuringiensis MO19
MSVVYYVKGGDIVDPFSNYSEQKYPDSNNNQELITESSSFYSDTTNENMKTYHPIEQDILKFANQEFPDNYYQHSDVSNSYQNMKTEIVNTDLPYNTNNINSMRNTLCRDLPPETNMSIYDNLRSTVTVPSFSNQFDPIKFLHDIEIAIETGSFSALTQSNMNQGGTDIAPMLISTFFKVAGSLLPFPLSSLGALASFYVTDSQTGAMANLWRQMVDYVEKRIDSKILDYHNFIMGAELAALNASLKEYARVVKIFENDMNRIAEPPSTGVITQFRILNDNFIKYIAKLQFSTNQSDLQYPVLTLPLRAQACVMHLMLLKDATTSVWGQQIDSQQLNGYKAELIRLIKVYTNDVNTTYNQGLELEKAKPLNYSDPEEYLQAGRPDISVLRSNFREVMKWNKVAKYKRGMAMSALSLAALFPTFGPNYPKQALKVVQSRQIFAPVIGIPGGITSQDHSGTFGTMRFDVQTYDQIDALRQLMELYIQPLKSAYFYIYESDGKVRATYVNDYIGKRGSNTGAAWGMWSSDPSAIYTSALGAAGYAPNVVGVRYSNGGSYTKGMAPANTNAYAPFEFKYPGYKLHSVSAYGLSKAPDAADSVMFGFRPVLLENEANQLLTDIALQIPAEIALTRPNLNINQLLVEETINGQNALQLWEPNFPGDSTNIFNYNINSPREQNYKIIYRIASNSPAQISLNYNSKFFLTDIPNTSLDPNGVKGTYGSYTLIEGPIIRFSPGANIFSISSEINTFAIDSIIFSPVS

SEQ ID NO: 324 - protein, 1236 aa, Bacillus thuringiensis yunnanensis
MDPNDHNEYEVMDTGSMGYQPRYPLANAPGAELQQMHYKDWMDMCTYGESVALSEGLRAALFVANSIIGIMLSKIPIVGPIVSTPFQIMGVALPFLWPPNAPEPQFSWESLMTAAEEIADKKIDAQVRANANAELEGVHNAIRLYQDAVCDWKQDPTNAQLKEQLRIQYIATNTVIFSRMPSFRVRGFEVPLLSTYVQAANLHLIHLKDGVQFGEEWGMDSATVDRFYSYLKSDIEIYTNYCIDWYNKGLSDSIESEPTWNGWNTFNNFRRDMTLMVLDLVSIWPTYDPRRYPLPTKSQLTRELYTQAIGSYKSVEPLLPPPSPFRWLREIEFFLRDSQDEAEQFAGFQQGYQYTLDTTIYRPPVVGTRTSLVDSIAMGLGSDDVVYRIKNISHNGWYPKKLDFYYTPSERVESVGEIRTDANNMIDYIGLGCRAKVTEPCDPCTTNCTIDTVNTTASCDNPNLYSHRLSSINPSAPYPGQNGMLSFCYGWTHFSVDDNNLIAADSITQIPAVKAYRIGGYGKVMKGPGYTGGDLMVFYGAGEINWRLTIPDTTKAYRVRARVATIPTSQPVDTVRYNQFEYRDIEVISPTTTVHEYSIGFDITGDDWGLLDKIEFIPIEGPVEAYQADQALEKARKAVNALFTNDAKNALQLKVTDYSVDQAANLIECVSDAFHSQEKMILLDQIKYAKRLSQARNLLNYGDFESSDWSGENGWRTSPHVHVASNHPIFKGRYLHMPGATSSQFSNHIYPTYVYQKVDESKLKSYTRYLVRGFVGNSKDLELLVERYGKDVHVEMDVPNDIRYALPTNECGSLDRCRPASYQARTPHTCTCKDTTSMHTDCQCQNKVNRTSADMYTNGSPSSVMYADGFHAHKSCGCKNNDMYPNGTDSHKSCRCKDPHVFSYHIDTGCVDQEESLGLWFALKIASENGVANIDNLEIIEAQPLTGEALARVKKREQKWKQEMTKKRLETEKAVQAAQSAIQNLFTNAQHNRLKFETLFPQIVHAEKLVEQIPYVHHPFLSGALPTVPGMNFEIIQQLLAVIGNARALYEQRNLVRNGTFSSGTGSWKVTEGVKVQPLQDTSVLVLSEWIHEASQQLHIDPNRGYVLRVTARKEGGGKGTVTMSDCADYTETLTFTSCDFNTSGSQTMTSGTLSGFVTKTLEIFPDTDRIRIDIGETEGTFQVESVELICMEQMEEDLYDIAGNVVEEMRYLDSSRSMGGTLDAMCYTKIGEFGC

SEQ ID NO: 325 - protein, 1270 aa, Bacillus thuringiensis
MNQNDNKNEYEILDSGNLSYQPRYPLANAPGSKLQNMGYKEWRDMCPDAKRQLLKQIGISPFEPDEWTKVGQSLTISAGLVAAIAGVASVAFPPLAIVAGAFAIISMFFDVLWPESENNTNSQVVWADFAAAAEEMMDEKIADEIKAEAVLQLRIVQSRLRDYQQAACNFQSDPNNESYKALLRDAFDDADDALKEVMILFSREGYEQLLLFDYVQAANLHLLLLKDVVRFGVGWGFPPGRVEQYYSNPTNLGNPGMVQLLAKYTNYSTSLCWKGIEERKWMVESEYRSNNEEYYAYRSNMTMMVLDMVALWPTYDPVKYPYATAVELTREIYSLIAGGFRDYKGYMPIQYTWEKPGSLVTNLERFTIYTWKNFEYFPFAGVETTYQTIGTGSSSTKQAGVIPSPEEGTAWTTPGINVEYHLVESFIYGTLTQLLFYDVYNTPAFKAGSDAVEVPGSIAGTPCKNIPLDANDVNVCVPTLWEESPANPEGVCYPYNREMQSNLLSEVIPEDPKLLTLPHVPPLGYIDAFAFAWRSTTCDTRYNLIPANKIGQIPAVKGNWLGQSGSSVVRTSGNTGGDVVRLYEFGNLGMTVRFSENRSYIIRLRYATVADDLNIIVRVQRRGELEYESELPLNQTSNNSTTQWKFEDYGYQEVGGFYPQVGEEYELWFSPVGTELSSHMDIDKIEFIPMETSLEEYLANQDIEKARKAVNALFTGDVKNALKLNVTDYAIDQAANLVECVSEEFYAQEKMILLDQVKVAKRLSQARNLLNYGDFESPEWSRENGWKTSRHVSVRADNPVFKGRYLHMPGVTSPSFSNNTYPTYVYQKVDESKLKSYTRYLVRGFVGNSKDLELLVERYGKDVHVEMDVPHDIRYSLQTNECGGFDRCRPVSYLARSSHACTCKDTASMHTDCQCQNKANRTVTNMYTNVSPGSAMYTDGFHAQKSCGCKNNDMYQNGTHPHKSCGCKDPHVFSYHIDTGCVDPEENLGLWFALKIAGENGVANIDNLEIIEAQPLTGEALARVKKREQRWKQERDKKRLETEKAVQTAQGAIQNLFTNTQQNLLKFETLFPQIVNAEMLVQQIPYVYHPFLSGALPAVAGMNFKIVQQLSATIGNARSLYNQRNLVQNGTFSSGTGSWHVSEGVEVQPLQNTSVLVLSEWSHEASQQVSVDPDRGYVLRVTARKEGVGKGTVTLSDCADYTETLTFTSCDFNTSGSQTMTSGTLSGFVTKTLEIFPDTDRIRIDIGETEGTFKIESVELICMEQMEDDL

SEQ ID NO: 326 - protein, 1254 aa, Bacillus thuringiensis
MNSNYNNEHEILDMNNRSYQTRYPLANAPGVELQQMSYKDWMDRCEQESLAITFKSVITTALDITSAILGAAKSPKAKVARAAVQVLNTVIKLLWPDPEKPSEPAYDIDFIWKELIGRVEILIEEKIDREAYNAAIGRLSGLKRALSLYQESFETWIDDENDPELQEDVRMRFTSTLFELVTTIETFKYSGQELNLLTVFVQAADFHLMLLQQGVMYGVRWGFDQRTVDSFYQNDRGEGLKNLLPKYSDYCTYWYDQGLNRAKNLKANLSDTVRYPWAANLENMSVLQELEDWNLYNDYRRDMTILVLDLVAVWPTYDLHYYDNGNYGVQSELTRSIYSQAVGNVMGTVFTKEQYEVSFVRPPHLVTWLEKMFIQIRPTEQGAPIDATMAGVSLYYSYSGWDNTVDDILLGYPTYSSSEIRVLSKSKVIVQDQEKNRAIYNTDLQHDKLVDRFVFYQNSGEVNYAGRDNPSSYKTFAWDTDITNYSSQMTWINGPVNEGHFGYIQAYAPEWIPASCEPFNNIVDAEDVITQIPAVKARELRYGARVIKGVGNTGGDLVSIAPHGLCELYVSFPNVVRRYQVRIHYACQDPTKINLNIGDSRHDITLPSTYSGGALTYDSFGYATSEYSYLFYADFYDEKQIVRLGNSFDISQQDVIIDKIEFIPVDIFYAEEQDLEKARKAVNALFTNDAKNALQLDVTDYAVDQAANLVECVSDEFHAQEKMILLDQVKFAKRLSQARNLLNYGDFESSDWSGENGWRTSPHVHVASDNPIFKGRYLHMSGAMSPQFSNNIYPTYAYQKVDESKLKSYTRYLVRGFVGNSKDLELLVERYGKDVYVEMDVPNDIRYTLPRNECGDFDRCKPASYQTKPPHTCTCKDPAVAHTDCQCKDKGNHTSTNMYTNGPTGSEVSTNGFHAHKSCGCGDKHMDKSGTHPHKSCGCKDPHVFTYHIDTGCVDTEENLGLFFALKIASENGVANIDNLEIIEAQPLTGEALARVKKREQRWKQEMTKKRLETETAVQAAQDAIQNLFTNTQYNRLKFETLFPHIVNAELLVQQIPYVYHPFLSGALPVVPGMNFDIFQQLSFLIDTAKRLYEARNLVQNGTFSSGTGSWYVTAGVEVHRLQNTSVLVLSEWSHEASQQVRIDSDRGYVLRVTARKEGAGKGTVTLSDCADYTETLSFTSCDYNTVGTQTMTKGTLSGFVTKTLENFPDTDRIRIDIGETEGTFKVESVELICMEQMEDHLYDMAGNLEQDLT

SEQ ID NO: 327 - protein, 1280 aa, Bacillus thuringiensis
MKQNYNDEYDIIDNGGRGDQSRYPLTNAPSAELQDMNYIEWLDNCTLKEQVELFRDTSTTVRDALATTAGIITALLSVSNPAAAATAGIITILIPQLWPSGSDEVTWEKFMAAAEILIQKQITEAVRNKALTELEGVYRTIRLYQLAAERWNQNKNDPQAQESIRTQFRATNTIIEFAMPSFRVAGFEVPLLNVYAEAANLQLALLRDAVKFGRDWGLPQDEVDDIYSEQLLPRIAEHTDHCVTYFNRGLEEAKKLKANLNDYARYPWAQYINHSKIQGIENWNLFNDYRRNMTILVLDLVALWPTYDPRRYSMVTKSELTRELYTSVRGAFYGHNNDYDQNFEEIERNIISPPHLVTWPINFTVYTQNDYYYPMAGLQHKFNYTESIVSLESPVTGVTGTSNLINFVTADPFILAVTIIGFGQLGTSLGIYAMSFGRKSGSISHVGDIEIGTDDYLDIVDRIPVGDSTPNKLSWMSAAPTTLGSTTFLQYVSYAWRHPSVDSNNRISIDKITQIPAVKAFFIDDNHVKVIKGPGSTGGDLVAFSREGYGLSISVFIPGSDLVSFYRVRIRYASSQSAKVTMGFGGGVEESESKFNFPATYSGGNLTYNSFGYINTLAIASQSTAQTIEVYFRQYEEAEFIVDKLEFIPMEMSLEEYQADQDLEKARKAVNALFTSDAKSELKVNITDYAVDQAANLVECVSEDFHAQEKRILLDQVKFAKRLSQARNLLNYGDFESLDWSGENGWRTSPHVHVASDNPIFKGRYLHMPGAMSPQYSNNTYPTYAYQKVDESKLKSYTRYLVRGFVGNSKDLELLVERYGKEVHVEMDVPNDIRSTLPMNECGGFERCGKVSYQAVSDHTCTCKDTARMNTDCQCKDKINHMTTGVYTSMPVGSAMYPDGYHAHKSCKCGDKTMYGNGKHPHKSCGCKDPHVFSYHIDTGCVDQEENLGLWFALKIASENGVANIDNLEIIEALPLTGEALARVKKREHKWKQEMEQKRCKTEEAVQAAQTAINTLFTNTQYNRLKFETLFPHILHADELVQRIPYVYHPFLLGAYPDVPGMNYDIFQQLSALVNQARGLYDMRNLVRNGTFSAGIGNWQVTDGVATQPEGNTSVLILREWSDKAIQHLRIHAERGYVLRVTARKEGNGDGYVVIHDCDNQQEKLTFTACDYTTMGSSTGTQTMMTSPTNCMPCNSTTWKEEMKALVPMLSGYVTKTAEIFPDTDRIHIEIGETEGTFKIESVELICMEHMEEHAYDMEGDIEANIPPIVRPPIMPPTNV

SEQ ID NO: 328 - protein, 310 aa, Bacillus thuringiensis dakota
MAIIDFNQKIKDFCQWQVSNEFNPGRDLRNWVISYENTNISAVPRGASGGVATVNVTPVLKVASTQELYNGSSVTQSQTARFSETTQETQSSTTTEGARFSSTVTSTTKFTANVNFKAIGSGIDQTIAVAVTGEYNYSSSQTITTQRTRVWDVTQPVIVPPRTRIVATLLIYDAPFSIPIDLNCEVTGKIPINNGFSQDLAGATYDYTIGTNTRASSYTRLGMMAYYNWPGKVPEFVGYQSAGRAAFATLVYRGVGLQTAVQGLYSVVKFEEFPIGRQGETRTYYSPIQLADQNTSLAPDSNTIPIINPM

SEQ ID NO: 329 - protein, 119 aa, Bacillus thuringiensis PS80JJ1
MSAREVHIEINNKTRHTLQLEDKTKLSGGRWRTSPTNVARDTIKTFVAESHGFMTGVEGIIYFSVNGDAEISLHFDNPYIGSNKCDGSSDKPEYEVITQSGSGDKSHVTYTIQTVSLRL

SEQ ID NO: 330 - protein, 119 aa, Bacillus thuringiensis EG5899; identical to SEQ ID NO: 329

SEQ ID NO: 331 - protein, 119 aa, Bacillus thuringiensis PS69Q; identical to SEQ ID NO: 329

SEQ ID NO: 332 - protein, 119 aa, Bacillus thuringiensis PS185GG; identical to SEQ ID NO: 329

SEQ ID NO: 333 - protein, 123 aa, Bacillus thuringiensis PS149B1
MSAREVHIDVNNKTGHTLQLEDKTKLDGGRWRTSPTNVANDQIKTFVAESNGFMTGTEGTIYYSINGEAEISLYFDNPFAGSNKYDGHSNKSQYEIITQGGSGNQSHVTYTIQTTSSRYGHKS

SEQ ID NO: 334 - protein, 123 aa, Bacillus thuringiensis PS167H2
MSAREVHIDVNNKTGHTLQLEDKTKLDGGRWRTSPTNVANDQIKTFVAESHGFMTGTEGTIYYSINGEAEISLYFDNPYSGSNKYDGHSNKNQYEVITQGGSGNQSHVTYTIQTVSSRYGNNS

SEQ ID NO: 335 - protein, 123 aa, Bacillus thuringiensis EG9444
MSAREVHINVNNKTGHTLQLEDKTKLDGGRWRTSPTNVANDQIKTFVAESHGFMTGTEGHIYYSINGEAEISLYFDNPYSGSNKYDGHSNKPQYEVTTQGGSGNQSHVTYTIQTASSRYGNNS

SEQ ID NO: 336 - protein, 123 aa, Bacillus thuringiensis KR1369
MSAREVHIDVNNKTGHTLQLEDKTKLDGGRWRTSPTNVANDQIKTFVAESHGFMTGTEGTIYYSINGEAEISLYFDNPYSGSNKYDGHSNKPQYEVTTQGGSGNQSHVTYTIQTASSRYGNNS

SEQ ID NO: 337 - protein, 132 aa, Bacillus thuringiensis EG4851
MSAREVHIEIINHTGHTLQMDKRTRLAHGEWIITPVNVPNNSSDLFQAGSDGVLTGVEGIIIYTINGEIEITLHFDNPYAGSNKYSGRSSDDDYKVITEARAEHRANNHDHVTYTVQRNISRYTNKLCSNNS

SEQ ID NO: 338 - protein, 132 aa, Bacillus thuringiensis PS201L3
MSAREVHIEIINHTGHTLQMDKRTRLAHGEWIITPVNVPNNSSDLFQAGSDGVLTGVEGIIIYTINGEIEIPLHFDNPYAGSNKYSGRSSDDDYKVITEARAEHRANNHDHVTYTVQRNISRYTNKLCSNNS

SEQ ID NO: 339 - protein, 132 aa, Bacillus thuringiensis PS201HH2; identical to SEQ ID NO: 337

SEQ ID NO: 340 - protein, 385 aa, Bacillus thuringiensis PS80JJ1
MLDTNKVYEISNLANGLYTSTYLSLDDSGVSLMSKKDEDIDDYNLKWFLFPIDNNQYIITSYGANNCKVWNVKNDKINVSTYSSTNSVQKWQIKAKDSSYIIQSDNGKVLTAGVGQSLGIVRLTDEFPENSNQQWNLTPVQTIQLPQKPKIDEKLKDHPEYSETGNINPKTTPQLMGWTLVPCIMVNDSKIDKNTQIKTTPYYIFKKYKYWNLAKGSNVSLLPHQKRSYDYEWGTEKNQKTTIINTVGLQINIDSGMKFEVPEVGGGTEDIKTQLTEELKVEYSTETKIMTKYQEHSEIDNPTNQPMNSIGLLIYTSLELYRYNGTEIKIMDIETSDHDTYTLTSYPNHKEALLLLTNHSYEEVEEITKIPKHTLIKLKKHYFKK

SEQ ID NO: 341 - protein, 385 aa, Bacillus thuringiensis EG5899
MLDTNKVYEISNLANGLYTSTYLSLDDSGVSLMSKKDEDIDDYNLKWFLFPIDNNQYIITSYGANNCKVWNVKNDKINVSTYSSTNSVQKWQIKAKDSSYIIQSDNGKVLTAGVGESLGIVRLTDEFPENSNQQWNLTPVQTIQLPQKPKIDEKLKDHPEYSETGNINPKTTPQLMGWTLVPCIMVNDSGIDKNTQIKTTPYYIFKKYKYWNLAKGSNVSLLPHQKRSYDYEWGTEKNQKTSIINTVGLQINIDSGMKFEVPEVGGGTEDIKTQLTEELKVEYSTETKIMTKYQEHSEIDNPTNQPMNSIGLLIYTSLELYRYNGTEIKIMDIETSDHDTYTLTSYPNHKEALLLLTNHSYEEVEEITKIPKHTLIKLKKHYFKK

SEQ ID NO: 342 - protein, 385 aa, Bacillus thuringiensis PS69Q; identical to SEQ ID NO: 341

SEQ ID NO: 343 - protein, 385 aa, Bacillus thuringiensis PS185GG; identical to SEQ ID NO: 340

SEQ ID NO: 344 - protein, 383 aa, Bacillus thuringiensis PS149B1
MLDTNKVYEISNHANGLYAATYLSLDDSGVSLMNKNDDDIDDYNLKWFLFPIDDDQYIITSYAANNCKVWNVNNDKINVSTYSSTNSIQKWQIKANGSSYVIQSDNGKVLTAGTGQALGLIRLTDESSNNPNQQWNLTSVQTIQLPQKPIIDTKLKDYPKYSPTGNIDNGTSPQLMGWTLVPCIMVNDPNIDKNTQIKTTPYYILKKYQYWQRAVGSNVALRPHEKKSYTYEWGTEIDQKTTIINTLGFQINIDSGMKFDIPEVGGGTDEIKTQLNEELKIEYSHETKIMEKYQEQSEIDNPTDQSMNSIGFLTITSLELYRYNGSEIRIMQIQTSDNDTYNVTSYPNHQQALLLLTNHSYEEVEEITNIPKSTLKKLKKYYF

SEQ ID NO: 345 - protein, 383 aa, Bacillus thuringiensis EG9444
MLDTNKVYEISNHANGLYAATYLSLDDSGVSLMNKNDDDIDDYNLKWFLFPIDDDQYIITSYAANNCKVWNVNNDKINVSTYSSTNSIQKWQIKANGSSYVIQSDNGKVLTAGTGQALGLIRLTDESSNNPNQQWNLTSVQTIQLPQKPIIDTKLKDYPKYSPTGNIDNGTSPQLMGWTLVPCIMVNDPNIDKNTQIKTTPYYILKKYQYWQRAVGSNVALRPHEKKSYTYEWGTEIDQKTTIINTLGFQINIDSGMKFDIPEVGGGTDEIKTQLNEELKIEYSRETKIMEKYQEQSEIDNPTDQPMNSIGFLTITSLELYRYNGSEIRIMQIQTSDNDTYNVTSYPDHQQALLLLTNHSYEEVEEITNIPKSTLKKLKKYYF

SEQ ID NO: 346 - protein, 383 aa, Bacillus thuringiensis PS167H2
MLDTNKIYEISNYANGLHAATYLSLDDSGVSLMNKNDDDIDDYNLRWFLFPIDDNQYIITSYAANNCKVWNVNNDKINVSTYSSTNSIQKWQIKANASSYVIQSNNGKVLTAGTGQSLGLIRLTDESPDNPNQQWNLTPVQTIQLPPKPTIDTKLKDYPKYSQTGNIDKGTPPQLMGWTLIPCIMVNDPNIDKNTQIKTTPYYILKKYQYWQQAVGSNVALRPHEKKSYAYEWGTEIDQKTTIINTLGFQINIDSGMKFDIPEVGGGTDEIKTQLNEELKIEYSRETKIMEKYQEQSEIDNPTDQSMNSIGFLTITSLELYRYNGSEISVMKIQTSDNDTYNVTSYPDHQQALLLLTNHSYEEVEEITNIPKISLKKLKKYYF

SEQ ID NO: 347 - protein, 387 aa, Bacillus thuringiensis EG4851
MIETNKIYEISNKANGLYATTYLSFDNSGVSLLNKNESDINDYNLKWFLFPIDNNQYIITSYGVNKNKVWTANGNKINVTTYSAENSAQQWQIRNSSSGYIIENNNGKILTAGTGQSLGLLYLTDEIPEDSNQQWNLTSIQTISLPSQPIIDTTLVDYPKYSTTGSINYNGTALQLMGWTLIPCIMVYDKTIASTHTQITTTPYYILKKYQRWVLATGSGLSVPAHVKSTFEYEWGTDTDQKTSVINTLGFQINTDTKLKATVPEVGGGTTDIRTQITEELKVEYSSENKEMRKYKQSFDVDNLNYDEALNAVGFIVETSFELYRMNGNVLITSIKTTNKDTYNTVTYPNHKEVLLLLTNHSYEEVTALTGISKERLQNLKNNWKKR

SEQ ID NO: 348 - protein, 387 aa, Bacillus thuringiensis PS201L3; identical to SEQ ID NO: 347

SEQ ID NO: 349 - protein, 387 aa, Bacillus thuringiensis PS201HH2; identical to SEQ ID NO: 347

SEQ ID NO: 350 - protein, 520 aa, Bacillus thuringiensis
MNVNHGMSCGCGCQQGKEEYNDYHVSNEYRDENPSTTCNSQQGNYEYEQSKETYNNDYQSYEYNQQNYNTCGRNQGTMEQESMQKDRNWENANYSGYDGCSPNQLNALNLPDESTRFQKITNVNTRDSHRVLDMMDVPSGTRLDTRVPPICSQTEFTNTVSNELVSTNHDTQFLIFYQTDDSSFIIGNRGNGRVLDVFPSNRNGYTIVSNVYSGSRNNQRFRMNKASNNQFSLQTIFKDRVNICGHIHNFNAIITATTLGENDSNALFQVQSSTNITLPTLPPRTTLEPPRALTNINDTGDSPAQAPRAVEGSVLIPAIAVNDVIPVAQRMQESPYYVLTYNTYWHRVISAILPGSGQTTRFDVNLPGPNQSTMVDVLDTAITADFRLQFVGSGRTNVFQQQIRNGLNILNSTTSHRLGDETRNWDFTNRGAQGRLAFFVKAHEFVLTRANGTRVSDPWVALDPNVTAAQTFGGVLLTLEKEKIVCASNSYNLSVWKTPMEIKNGKIYTKNEWNTKPNYK

SEQ ID NO: 351 - protein, 126 aa, Bacillus thuringiensis
MTVYNATFTINFYNEGEWGGPEPYGYIKAYLTNPDHDFEIWKQDDWGKSTPERSTYTQTIKISSDTGSPINQMCFYGDVKEYDVGNADDILAYPSQKVCSTPGVTVRLDGDEKGSYVTIKYSLTPA

SEQ ID NO: 352 - protein, 310 aa, Bacillus thuringiensis
MSILNLQDLSQKYMTAALNKINPKKVGTFHFEEPIVLSESSTPTRSEIDAPLNVMFHASQDLDNRRGTSDLKQTVSFSQTQINTVETKTTDGVKTTKEHTFSGTLELKIKYAMFDLGGVSGTYQYKKSTENDISSEKSKSKSDSQTWSISSEYTVKPGVKETLDFYIVGIKTEVPLNIFAEFQGTKTIDNVSNVMAYQEFISQDDEHIRACMKASKLANPDHLSGYTAPKELKANTSKGSVEFRGTAIAKINTGVKCLVVVNGKNSITGKTYSYIHPKTMLADGTIEYLESEIDLLESEIDLLTTSSILV

SEQ ID NO: 353 - protein, 660 aa, Bacillus thuringiensis aizawai
MNSYENKNEYEILNDSKKSNMSNPYLRYPLANDSLASMQNTNYKDWLTMCDRTDTDVLSSRGAVSTGVGMLSTILSLFGIPLIGEGIDLLLGAADFLWPESDGGHQYTWEDLMNHIEELMDERLETEKRTTALDDLRGLKALLGLFRDAFDSWEKNQNDPIAKNRVGGYFEDVHTHFVKDMASIFSATNYEVLLLPVYAQAANLHLLLLREGVIYGSRWGIAPAADFYHDQLLKYTAIYANHCVTWYNNGLAQQKELFAKSPNWNRFNAYRRDMTITVLDIIALFPTYDARLYTKPIKTELTREIYSDVLNLDVYGVQQTDLNKNEAAFTRSPHLVTRLRGFDFYTRTKYAYWRYLAGHTNYFSFTGNGTIYSSSFNNWYDTDMTKSTINIPDYANIYKLWTKSYTNISPYTDPVGISQMQFSLTNNQQLTYTGTSAPKYPVRETFFEIPPTDEKPLTYENYSHILSYMTSAQHFGDKKIGYTFAWMHESVDFDNRVDPDKITQIPAVKGDYLQYGYVKQGPGHTGGDLVSMIRTDRLGINVYFPQPLDYRIRIRYSTSSNGYLYIYSPNTKIVYLPPTTLVDGQPTFDPMDFSAFRVVEVPASFRASVAGYTNFTIEAGFGPVYIDKIEFIPDNTTTLEYEGGRDLEKTKNAVNDLFTN

SEQ ID NO: 354 - protein, 652 aa, Bacillus thuringiensis san diego
MIRKGGRKMNPNNRSEHDTIKTTENNEVPTNHVQYPLAETPNPTLEDLNYKEFLRMTADNNTEALDSSTTKDVIQKGISVVGDLLGVVGFPFGGALVSFYTNFLNTIWPSEDPWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 355 - protein, 652 aa, Bacillus thuringiensis 886
MIRKGGRKMNPNNRSEHDTIKTTENNEVPTNHVQYPLAETPNPTLEDLNYKEFLRMTADNNTEALDSSTTKDVIQKGISVVGDLLGVVGFPFGGALVSFYTNFLNTIWPSEDPWKAFMEQVEALMDQKIADYAKNKALAELQGLQNNVEDYVSALSSWQKNPVSSRNPHSQGRIRELFSQAESHFRNSMPSFAISGYEVLFLTTYAQAANIHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFRPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPPEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKHRARIHYASTSQITFTLSLDGAPFNQYYFDKTINKGDTLTYNSFNLASFSTPFELSGNNLQIGVTGLSAGDKVYIDKIEFIPVN

SEQ ID NO: 356 - protein, 644 aa, Bacillus thuringiensis tenebrionis Mm2
MNPNNRSEHDTIKTTENNEVPTNHVQYPLAETPNPTLEDLNYKEFLRMTADNNTEALDSSTTKDVIQKGISVVGDLLGVVGFPFGGALVSFYTNFLNTSWPSEDPWKAFMEQVEALMDQKIADYAKNKALAELQGLQNNVEDYVSALSSWQKNPVSSRNPHSQGRIRELFSQAESYFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFNYLRRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 357 - protein, 644 aa, Bacillus thuringiensis tenebrionis
MNPNNRSEHDTIKTTENNEVPTNHVQYPLAETPNPTLEDLNYKEFLRMTADNNTEALDSSTTKDVIQKGISVVGDLLGVVGFPFGGALVSFYTNFLNTIWPSEDPWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 358 - protein, 644 aa, Bacillus thuringiensis tenebrionis; identical to SEQ ID NO: 357

SEQ ID NO: 359 - protein, 644 aa, Bacillus thuringiensis; identical to SEQ ID NO: 357

SEQ ID NO: 360 - protein, 644 aa, Bacillus thuringiensis tenebrionis
MNPNNRSEHDTIKTTENNEVPTNHVQYPLAETPNPTLEDLNYKEFLRMTADNNTEALDSSTTKDVIQKGISVVGDLLGVVGFPFGGALVSFYTNFLNTIWPSEDPWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENASAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 361 - protein, 644 aa, Bacillus thuringiensis morrisoni EG2158; identical to SEQ ID NO: 357

SEQ ID NO: 362 - protein, 644 aa, Bacillus thuringiensis tenebrionis; identical to SEQ ID NO: 357

SEQ ID NO: 363 - protein, 652 aa, Bacillus thuringiensis 22; identical to SEQ ID NO: 354

SEQ ID NO: 364 - protein, 652 aa, Bacillus thuringiensis YM-03
MIRKGGRKMNPNNRSEHDTIKTTENNEVPTNHVQYPLAETPNPTLEDLNYKEFLRMTADNNTEALDSSTTKDVIQKGISVVGDLLGVVGFPFGGALVSFYTNFLNTIWPSEDPWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTQFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 365 - protein, 644 aa, Bacillus thuringiensis UTD-001
MNPNNRSEHDTIKTTENNEVPTNHVQYPLAETPNPTLEDLNYKEFLRMTADNNTEALDSSTTKDVIQKGISVVGDLLGVVGFPFGGALVSFYTNFLNTIWPSEDPWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYKKEDIAEFLKRQLKLTQEYTDHFVQWYYVGLDKIRGSFYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLGFNGEKVYRAVANTNLAVWPSAVNSGVTKVKFSQYNDQTDEASTQTSDSKRNVGAVSWDSIDQLPPEATDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 366 - protein, 659 aa, Bacillus thuringiensis tolworthi 43F
MIRMGGRKMNPNNRSEYDTIKVTPNSELPTNHNQYPLADNPNSTLEELNYKEFLRMTADNSTEVLDSSTVKDAVGTGISVVGQILGVVGVPFAGALTSFYQSFLNAIWPSDADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 367 - protein, 651 aa, Bacillus thuringiensis PGSI208
MNPNNRSEYDTIKVTPNSELPTNHNQYPLADNPNSTLEELNYKEFLRMTADNSTEVLDSSTVKDAVGTGISVVGQILGVVGVPFAGALTSFYQSFLNAIWPSDADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 368 - protein, 652 aa, Bacillus thuringiensis EG4961
MNPNNRSEHDTIKVTPNSELQTNHNQYPLADNPNSTLEELNYKEFLRMTEDSSTEVLDNSTVKDAVGTGISVVGQILGVVGVPFAGALTSFYQSFLNTIWPSDADPWKAFMAQVEVLIDKKIEEYAKSKALAELQGLQNNFEDYVNALNSWKKTPLSLRSKRSQDRIRELFSQAESHFRNSMPSFAVSKFEVLFLPTYAQAANTHLLLLKDAQVFGEEWGYSSEDVAEFYHRQLKLTQQYTDHCVNWYNVGLNGLRGSTYDAWVKFNRFRREMTLTVLDLIVLFPFYDIRLYSKGVKTELTRDIFTDPIFSLNTLQEYGPTFLSIENSIRKPHLFDYLQGIEFHTRLQPGYFGKDSFNYWSGNYVETRPSIGSSKTITSPFYGDKSTEPVQKLSFDGQKVYRTIANTDVAAWPNGKVYLGVTKVDFSQYDDQKNETSTQTYDSKRNNGHVSAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNKDDDLTYQTFDLATTNSNMGFSGDKNELIIGAESFVSNEKIYIDKIEFIPVQL

SEQ ID NO: 369 - protein, 652 aa, Bacillus thuringiensis EG5144
MNPNNRSEHDTIKVTPNSELPTNHNQYPLADNPNSTLEELNYKEFLRMTEDSSTEVLDNSTVKDAVGTGISVVGQILGVVGVPFAGALTSFYQSFLDTIWPSDADPWKAFMAQVEVLIDKKIEEYAKSKALAELQGLQNNFEDYVNALNSWKKTPLSLRSKRSQDRIRELFSQAESHFRNSMPSFAVSKFEVLFLPTYAQAANTHLLLLKDAQVFGEEWGYSSEDVAEFYHRQLKLTQQYTDHCVNWYNVGLNGLRGSTYDAWVKFNRFRREMTLTVLDLIVLFPFYDVRLYSKGVKTELTRDIFTDPIFSLNTLQEYGPTFLSIENSIRKPHLFDYLQGIEFHTRLQPGYSGKDSFNYWSGNYVETRPSIGSSKTITSPFYGDKSTEPVQKLSFDGQKVYRTIANTDVAAWPNGKIYFGVTKVDFSQYDDQKNETSTQTYDSKRNNGHVGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFIVIYINKTMNIDDDLTYQTFDLATTNSNMGFSGDTNELIIGAESFVSNEKIYIDKIEFIPVQL

SEQ ID NO: 370 - protein, 649 aa, Bacillus thuringiensis kurstaki BtI109P
MNPNNRSEHDTIKATENNEVSNNHAQYPLADTPTLEELNYKEFLRRTTDNNVEALDSSTTKDAIQKGISIIGDLLGVVGFPYGGALVSFYTNLLNTIWPGEDPLKAFMQQVEALIDQKIADYAKDKATAELQGLKNVFKDYVSALDSWDKTPLTLRDGRSQGRIRELFSQAESHFRRSMPSFAVSGYEVLFLPTYAQAANTHLLLLKDAQIYGTDWGYSTDDLNEFHTKQKDLTIEYTNHCAKWYKAGLDKLRGSTYEEWVKFNRYRREMTLTVLDLITLFPLYDVRTYTKGVKTELTRDVLTDPIVAVNNMNGYGTTFSNIENYIRKPHLFDYLHAIQFHSRLQPGYFGTDSFNYWSGNYVSTRSSIGSDEIIRSPFYGNKSTLDVQNLEFNGEKVFRAVANGNLAVWPVGTGGTKIHSGVTKVQFSQYNDRKDEVRTQTYDSKRNVGGIVFDSIDQLPPITTDESLEKAYSHQLNYVRCFLLQGGRGIIPVFTWTHKSVDFYNTLDSEKITQIPFVKAFILVNSTSVVAGPGFTGGDIIKCTNGSGLTLYVTPAPDLTYSKTYKIRIRYASTSQVRFGIDLGSYTHSISYFDKTMDKGNTLTYNSFNLSSVSRPIEISGGNKIGVSVGGIGSGDEVYIDKIEFIPMD

SEQ ID NO: 371 - protein, 666 aa, Bacillus thuringiensis aizawai
NSYENKNEYEILESSSNNTNMPNRYPFANDRDMSTMSFNDCQGISWDEIWESAETITSIGIDLIEFLMEPSLGGINTLFSIIGKLIPTNHQSVSALSICDLLSIIRKEVADSVLSDAICRFLDGKLKNYREYYLPYLEAWLKDGKPLQKTNNSDIGQLVKYFELSERDFNEILGGSLARNNAQILLLPYFCASCKCQLLLLRDAVQYEEQWFPFLSAENVRSELISPNSGCDFTGDYYERLKCKIAEYTDYCEYWYQAGLNQIKQAGTGADTWAKFNKFRREMTLTVLDIIAIFQTYDFKKYPLPTHVELTREIYTDPVGYSSGTYSWLKYWTGAFNTLEANGTRGPGLVTWLRSIGIYNEYVSRYFSGWVGTRHYEDYTTGNGNFQRMSGTTSNDLRDISFPNSDIFKIESKAIMNLVGEINARPEYRVSRAEFSESTAFIYLYDAGNSGLSSMTITSKLPGIKNPEPSYRDYSHRLSNAACVGAGNSRINVYGWTHTSMSKYNLIYPDKITQIPAVKAFDISDTGPGQVIAGPGHTGGNVVSLPYYSRLKIRLIPASTNKNYLVRVRYTSTSNGRLLVERWSPSSIINSYFFLPSTGPGDSFGYVDTLVTTFNQPGVEIIIQNLDTPINVDKVEFIPVNSTALEYEGKQSLEKAQDVVNDLFVK

SEQ ID NO: 372 - protein, 666 aa, Bacillus thuringiensis serovar aizawai
MNSYQNKNEYEILKSSPNNTNIPNRYPFANDRDMSPMSWNDCQGSPWNDVWESTASFTGIGIDLITFLGEPSITGINLLFSVIGKLLPSGQNVASLSICDLLSIIRKEVDESVLSDAYGDFNGVVNNYQTYYLTSLKKWLDAGKPTTGQLLTDVTKHFEFSEREFNALLKGSLSRPKGEILLLPTYTQGANLHLLLLRDFVQYKAVWEKELRTENVESELISPSFDYEGHFKEQLAEHINHCITWYQAGLNQIKESGTSTENWLKFNKFRREMTLSVLDIIAIFPTYDFENYKSETHIELSREVYTDPVGYNGWEQNLTNGFNTLEANGTRGPGLVTWLKKIDIFTDEVTEYSGWSPVAILRGWAGTRHYEIYTGSSNTLQRISGTTSNDVSNIDFINSRIFIITSLARYALAGAAAGNPGSPRYRVSRVEFRSTGRYTFLYEVNSPGISSMTIESKLPGVKNATGFTDYFNRLSNAACVQFGTSRVNVYGWTHISMGEGNYVYPNKITQIPAVKAWEIRGTSSVVAGPGHTGGNLVKMSYHSVWSIKFTCQQLKRYRVRIRYASDGNCQLAMRRWRGGPGYVQEARHTVQRTFSGSMTYDSFKYLDIFTMPAEDYTFDLTIDLESGGALYIDKIEFIPDDLTTLEYEEERNLEKTKNAVNDLFTN

SEQ ID NO: 373 - protein, 657 aa, Bacillus thuringiensis Y41
MNSYENKNEYEILESSSNNTNMPNRYPFANDRDISPMSWNDCQGSSWEDVWESTSSLASIGIDLIDHMFIAGPSITSINLLFSIIGKLIPSSGQSISSLSICDLLSIIRKEVDESVLSGAYGDFNGVLANYRDYYLKSLKTWLDEGQPTTGQSLKDVTKHFEASEREFNALLQGSLSRPKGEILLLPTYAQGANFHLLLLRDFVQYKDAWANELRTENVESELISPTFDYEGRFKEQLAKHINHCIYWYQAGLDQIKQGGTGADIWTKFNKFRREMTLSVLDIIAIFPTYDFEKYPLPTHVELTREIYTDAVGYSSGTYSWLRNWPNTFNALEANGTRGPGLVTWLSKIGIYNEYVSRYFAGWVGTRHYEDYTKGNGIFQRMSGTTSNDLRNIDFQNADVYKITSLAIMNLVGETTARPEYRVSKADFRRVGGPDLNYDAGNNGLSRMTIESTFPLVLDSNGVRGPSHRLSNAACVVYGNSRVNVFGWTHTSMTKNNPIYTDKISQIPAVKAFEISNYATVYAGPGHTGGGVVGLTISYQLKIRLAPASTNKNYRVRVRYASTSNGRIRVERWSPSSVINNDFPYSSTGSRDIFGYVDTLVTTFYQSGVEIIIQNIAFGEIIIDKVELIPLDSTTLEYDGEQNLKKAQNVVNDLFTN

SEQ ID NO: 374 - protein, 658 aa, Bacillus thuringiensis S2096-2
MNSYQNTNGYEILESSSNNTNTPNRYPFANDPNIFPIILNDCPGKPWQDTWKSISNFISVMVSMAGFISSPGVLIGIPALLGIVNLLIPSSGPSVAALSICDLLSIIRKEVDESVLNDAVADFNGKLTNYKEYYLSSLQEWLSAGKPNDSRLSNVVEYFKKSEEGFNEILAGSLSRQNAQILLLPTFAQAANVQLLLLRDAVQYKKEWGALLSAEKVGSELISPTIDYGQRLKDKIAQYAKYCVFWYQEGLNQIKEEGAGTTTWLKFNKFRREMTLAVLDIIALFPIYDFEKYPLGTNVELTREIYTDPVGYSRGNYRWEGLFSFNSLEANGTRGPGLVTWLQAIDIYSHPVFTQPGYLIGWGGTRHYEDYTKGNGAFQRMSGTTSNDPHSISFGNTDIFKISSLARVELQPFVGYSIPRYRTSRAEFFPTTLNTLLYERNSSGYSQTIESVLPGIDKDLPPSARNYSHRLSNAACVQYETSVVNVFGWTHTSMTRNNPIYPDKITQIPAVKAFALENGAYVSAGPGDTGGDVVTLPYLGRLKIRLTPAPTNKNYRVRIRYATSYGASLMVQRWSPSGSESDYFGSSPTGPYPTFGYMNTLVTTFNQSGVEIIIENRHYSNIIIDKIEFLPDDLTTLESEGERNLEKTKKAVNDLFIN

SEQ ID NO: 375 - protein, 825 aa, Bacillus thuringiensis A1462
MNQNCNNNGYEVLNSGKGYCQPRYPFAQAPGSELQNMGYKEWMNMCTSGDPTVLGEGYSADVRDAVITSINIASYLLSVPFPPAGVAAGILGALLGLLWPTNTQAVWEAFMNTVEALINQKLDEYARSKAISELNGLKNVLELYQDAADDWNENPGDLRNKNRVLTEFRNVNGHFENSMPSFAVRNFEVNLLPVYAEAANLHLLLLRDAVKFGEGWGMSTDPGAERDDMYRRLRSRTEIYTDHCVNTYNQGLQQAKSLQANVSDYSRYPWTQYNQSGGFSYREAKGEYRGTENWNLYNAFRRDMTILVLDIIAQFPTYDPGLYSRPVKSELTREVYTDIRGTTWRSDANLNTIDAIENRMVGSRQLQLFTWLTEMKFYIRNTGSITSYTHGDLMVGLEKKIRKTNDNDQWLPLEGQNTSYTRIDRPGIELGKNYWYYARTQQWFETRLLQLWANTDVLSLNAGTVGNEFWVRDVPDYRNIYARSTRNHFIENHRLSWIKFEPVRDNCPFAWPGYKQLSALLFGWTHNSVDLNNIISQYRITQIPAVKAYWNRGAFSVIRGPGSTGGNLVQLGTGGEVSVKVRPEQTGSDWYRVRIRYAAGSRGRLNVKKYVSSIHASVTYDYNMTMSSSTQGTYNSFQYLDVYNFRLAEPEFEVWLTNESGGPIWIDKIEFIPLSPIPELPVYPGTYQIVTALNNSSVVTSEEFCMGIGLTTRCGVNLWSNNGNTLQKWRFVYNGDQNAFQIKSTPNEDLVLSGSNSGTSVTAETNQNRPNQYWLIEEAGNGYVYLRSKGNPNLVLDVAGTSTANGTNIILWNYNGSTNQKFKLS

SEQ ID NO: 376 - protein, 829 aa, Bacillus thuringiensis A1462
MNQSCNNNGYEVLNSGKGYCQPRYPFAQAPGSELQNMGYKEWMNMCTSGDPTVLGGGYSADVKDAVITSINIASYLLSVPFPPAGVAAGILGALLGLLWPTNTQAVWEAFMNTVEALINQKLDEYARSKAISELNGLKNVLELYQDAADDWNENPGDLRNKNRVLTEFRNVNGHFENSMPSFAVRNFEVNLLPVYAEAANLHLLLLRDAVKFGEGWGMSTDPGAERDDMYRRLRSRTEIYTDHCVNTYNQGLQQAKSLQANVSDYSRYPWTQYNQSGGFSYREAKGEYRGTENWNLYNAFRRDMTILVLDIIAQFPTYDPGLYSRPVKSELTREVYTDIRGTTWRSDANLNTIDAIENRMVGSRQLQLFTWLTEMKFYIRNTGSITSYTHGDLMVGLEKKIRKTNDNDQWLPLEGQNTSYTRIDRPGIELGKNYWYYARTQQWFETRLLQLWVNTDVLSLNAGTVGNEFWARDVPDYRNIYARSTRNHFIENHRLSWIKFEPVRDNCPFAWPGYKQLSALLFGWTHNSVDPFNTIASDRITQIPAVKGYLVDNGATVVRGPGNTGGDLVRLPAYNQQWTQLRVKVRPSTTARTRGYNVRIRYASEGNANLFVGKYVDTANRFYETGNYAVNQTFSGSMTYNSFKYLDAIGFAANEEEFRIELRCNSGGPIYIDKIEFIPVNPIPEPPEGIYQIVTALNNSSVVTSEEFCMGIGLTTRCGVNLWSNNGNTLQKWRFVYNGDQNAFQIKSTPNEDLVLSGSNSGTSVTAETNQNRPNQHWLIEEAGNGYVYLRSKGNPNLVLDVAGTSTANGTNIILWNYNGSTNQKFKLS

SEQ ID NO: 377 - protein, 864 aa, Bacillus thuringiensis serovar andalousiensis BGSC 4AW1
MPLFVVYKSEHTCYSTCEVKKGGLYMNPYFKNNAYEILDDGNMNYHPKYPLTQPLGSELQNIHYKDWLATFPERNDSILGENSSLRDGIITSTNIIAYLLSVPFPAAGAAAGILGALLGFLWPTNTQAVWEAFMEAVEALIDQKISDFAREQAIARLEGINKAIELYQNALSNLEKNPNNAVLREHVREQFIATNTYIVGSMPLFRVKGYEVPMLTMFTEAANLHLLILRDAAKFGASWDMDVSTIESYQQYLEKETVNYTDYCVGTYNVGLEEAKTLFADLCDLNTYPWTRYNQGWREEEKPNCSLQQINRYEQQLNEQINSYRAAFRYSPGEYQKLENWNLYNAFRRNMTIMVLDLVSLWPTYNPKQYVLPVKAELTREIYTDIRGTTYQSDESQNTLPVIEGRMIPPPRLFQWLRSFTFHLQNVHSDWTAGQIATGLQQTVQTTLGPSQVLPLTGVQGTSTTSFIPYIDGITRIDTQQWFEPRRFKFWSGGYIEKNFGSIEEKSPFWAEGPKWRVYEPSARANEILEHRLSWMTYEPVRSNAPFVYPQYKQLGALALGWTHQSVDPENRVVSDKITQIPAVKAYWNRGAFSVVKGSGSTGGDLVQLSPSGEVSIMVKPSRSGIGQFRVRIRYAATANGRLNIKKYVGSIHASQSYDYKQTTTSNLTFSAFQYLDVYNFNLAETQFEVWLTNESGGPIFIDKIEFIPTTPTPEPEPQNPPVPEGRYQMVTALNNSSIVDLNLSQRYVQIYGNGNAENQKWRFVYDASKDAYQIINVAAGQELVLSWFQYPEEPDAVIGEPNNKLNRQYWIFEDAGNGYTYVRNMADLNRVLDVPNGNTGNGTPIYASYFSGGTNQKFKLNKL

SEQ ID NO: 378 - protein, 810 aa, Bacillus thuringiensis A1462
MNQNYNNNGLEILDSGGVCSPRYPLANAPGSELQNMGYKEWLEMCSIKGAETFADKSTLSAQSQEGLRTAITIALSLLSNLPGPFGYPAKLLSIIFPFLWPTNTQAQWEAFMKVVEELVDQKIETFARDQAIQRLRGIQDVISLYQRDAKNFNDYPTSEPIQRQLLSQFTATNTFIVGSMSLFRVGRHEVPLLTTFVQAANLHLLLLRDAIMFGESWGMCPVTVAGYQNDFNNRIADYTDYSVSIYNQGLQKAKTLKANLRDYEKYPWARYYNSSVGPEFAYGDMENWNLYNNYRRDMTLMVLDLVALWPTYNPQQYPIAPKIQLTREIYTELRGNAGNTKRPSMDAIDAELIPPPRLFTWLESVDMHRWPTSAGYYYYTFQNAGIKHRYKYTLDSQTLTSSLRGASGNNFNLVPAEETINRVQNQHGEGLYTFSFYRSGQSDPFLNIGTTADKPYVSTMNRIPVEGDQTQANHRLSWITGMVIPELSIPAFGHYNPTYISCAAEGWTHLSVERSNEIKSDKITQIPAVKAFQLSNNASVVRGPGSTGGDLVQFSATSSGNKQLWIKVKPTTIALGRRFKVRIRYAAAANVTFTVQKCVTGVACWETATKSVTTTYSGTLTYNAFKYVDIFEIPANESEFSLEFLSTSGGPIYIDKIEFIPVNPIPEPPVPEGIYQIVTALNNSSVVDMDPGTWGTRHNVHLWQNNNTNNQKWRFVYNSSQGAYQIRNLADENLVLTREGANVKVVSYQNNNTAQYWIIEDAGNEYVYLKSKADPSRVLDVTGSSTQNGTNIQVWSNYGTLNQKFKLVKL

SEQ ID NO: 379 - protein, 1344 aa, Paenibacillus lentimorbus semadara
MNQYHNQNDNKSYNQSGNEMQIIQPSSNSLLYSPNKYPYATDPNVIAEGRSYKNWLDMCVGEGDGTRSLEAIAVAVGVRISHTIFRLLGVPYSAQGEQLFSFLLDTLWLEGNTQWEELMRHAEELINEQVPDYVRTKALAELTDLGNNLNLYIAAFEDWKRNPSSQEVRTRVIDRFNILDGLFEAYLPSFAVPGYEVPLLSVYANVVNIHLLVLRDSSIYGLDWGLSSTSVDNNYNRQQRNSATYANHCTTWYQTGLQRLQGSDASSWVNYNRFRREITLIVLDICALFSNYDVRSYPIQLRGELTRGIYTDPAVYSGTGSYSWLSQAPSFAEIENIAIREPSNFTWASYARVTTGTLEYLSSKNDFWKSHYMNYTETNSGILIQGPTYGMTTGTNIRIESVSMQEIYSVRLEAVAHAGAGGPFLGISTSEFFWSLGVRRYQNSRSPQFASQIITRQLPGVNSAVPSALDHSHELSYITAFPVRSVGTILVHEWTSTTVSRNNRIEPDKITQIPAVKSHTLSNCQVVSGTGFTGGNWLRPSDNGSFRLTITSFSSQSYRIRIHYASATFFYLDIRTGDTSNTFAVTPTTLSSGSQTVPYESFGFINIPYTFTTAPTESRYTFDFMFYSIGSANVLIDRIEIVPIGVPLFEYETKQQLEKARKAVNHLFTDGSKKALKEDTTDYEIDQAANVVDCISDECGHDKMILLDEVKYAKQLSQARNLLLNGNFDDLYSALEKENPWKTSPNVTIRQDNPIFKGHYLSMAGANDIEATNDTFPTYVYQKIDEAKLKPYTRYKVRGFVGSSKALELLVTRYNEEVDAILDVPDNIPHAPTPVCGEFDRCKPYSYPPLLPECNPEFINQMQPSSCHHNQMVDYNNMNTSTSTTMNPSMNPPLTPEIASSQSGFGRKHRKCHQAHQFEFHIDTGTIDLVEDLGIWVIFKICATDGYASLDDLEVIEEGALGVEALELVKKREKKWRHQKEQHCSQTKHKYDAAKHAVMALFTNKRYEKLKFETTISDILYADHLVQSIPYVYNKYVPEVPGMNYELYSELNTLVQNAFYLYDQRNLIKNGRFSNGLMHWQATPHARVEQEYEKSVLVLPNWDANVSQDLCIEHNRGYVLRVTARKEDPGAGNVTFSDCENHVDKLSFTSCDIATNAVPGAQANDPAAGVAYGQQGCQIDRVPYGQSGYRADGVAYEQSGHRTDGVPYRQSGYGTDGVTYEQSGHRADGVPYGQSGYRADGVAYEQSGHRADGVPYGQSGYGTDGVTYDQSANQTRKYHGCHTDGLPHPEHGCCYPDRVSDGQQLAYVTKSIDLFPDTDKVRIDIGETEGNFRVESVELICMEK

SEQ ID NO: 380 - protein, 1340 aa, Paenibacillus popilliae popilliae
MNQYQHQNDNKSYNQHGNEMQIIQPSSNSLLYSPNKYPYATDPNVIAEGRSYNNWLDTCVGVGDGTRSPETDAVAVGVRISHTIFRLLGVPYSAQGEQLFSFLLDTLWLEGNTQWEELMRHAEELINEQIPDYVRTKALAELTDLGNNLNLYIAAFEDWKRNPSSQEVRTRVIDRFNILDGLFEAYLPSFAVPGYEVPLLSVYANVANIHLLVLRDSSIHGLDWGLSSTSVDNNYNRQQRNSATYAIHCTTWYQTGLQRLQGSDASSWVNYNRFRREITLIVLDICALFSNYDVRSYPIQLRGELTRGIYTDPAVFSGTGSYSWLSQAPSFAEIENIAIREPSNFTWANYARVTTGTLEYLSSKNDFWKSHYMNYTETNSGILIQGPTYGMTTGTNIRIESVSMQEIYSVRLEAVAHAGAGGPFLGISTSEFFWSLGVRRYQNSRSPQFASQIITRQLPGVNSAVPSALDHSHELSYITAFPARSVGTILVHEWTSTTVSRNNRIEPDKITQIPAVKSHTLSNCQVVSGTGFTGGNWLRPSDNGSFRLTITSFSSQSYRIRIRYASATFFYLDIRTGDTSNTFAVTPTTLSSGSQTVPYESFGFINIPYTFTTAPTESRYTFDFMFYSIGSANVLIDRIEFVPIEGSLFEYETKQQLEKARKAVNHLFTDGSKKALKEDTTDYEIDQAANVVDCISDECGHEKMILLDEVKYAKQLSQARNLLLNGNFDDLYPALERENPWKTSPNVTIRRDNPIFKGHYLSMAGANDIEATNDTFPTYVYQKIDEAKLKPYTRYKVRGFVGSSKALELLVTRYNEEVDAILDVPDNIPHAPIPVCGEFDRCKPYSYPPLLPECNPEFINQMQPSSCHHTQMVDYNNMNMSTSTTMNPTLTPEIASSQSGFGRKHRKCHQAHQFEFHIDTGTIDLVEDLGLWVIFKICATDGYASLDDLEVIEEGALGVEALELVKKREKKWRHQKEQHCSQTKHKYDAAKHAVMALFTNTRYEKLKFETTISNILYADHLVQSIPYVYNKYVPEVPGMNYELYSELNTLVQNAFYLYDQRNLIKNGRFSNGLMYWQAAPHARVEQEFEKSVLVLPNWDANVSQDLCIEHNRGYVLRVTARKEDPGAGNVTFSDCENHVDKLSFTSCDIATNAVPGAQANDPAAGVAYGQQGCQIDRVPYGQSGYRADGVAYEQSGHRTDGVPYRQSGYGTDGVTYEQSGHRADGMPYGQSGYRADGVAYEQSGHRADGVPYGQSGYGTDGVTYDQSANQTRKYHGCHTDGLPHPEHGCCYPDRVSDGQQLAYVTKSIDLFPDTDKVRIDIGETEGNFRVESVELICMEK

SEQ ID NO: 381 - protein, 1332 aa, Paenibacillus lentimorbus semadara
MQIIQPSSNALLYSPNKYPYATDPNVIAEGRSYNNWLDTCVGVGDGTRSPEAYAIAEEAVGLSIDILAEIIYYLGFPIASPLTRALSAIAGQLFSSGDTLMQHIEQLINQKIAEYARNKALAEFQGLGRQYGLYLEALEDWEQNRLSQPHKERVRQTFRILDNSFTSSIPSFAVRNYEVPLLSVYADAANLHLLILRDSYIYGAFWGFDEDEYYRNYARQIRLSAEYANHCTTWYQTGLRRLQGTRATDWINYNRFRREMTLTVLDICALFSSYDIPSYPMGTKIQLTREIYTDPVVHSDWLQSTSPGLISFSSLENLVVRAPHLFTWLSRVTIDTGILSTVIGGQYSNNNFWRTHYQTLRTTGGTSFQSPTYGSTAFPIQRTNTLTFSGDVYTIESSVVTRSSLYGANSVAFTGTTGRSLYENPTVYPFAQKLIHELPGVDSGRPNATNYSHRLSYISGFSLGYSPSGTGLVYGWTSTTATRENNITLDDRIVQLPAVKGASLNNCQVVKGTGFTGGDWLKPNNNGTFSMYFAFRSAYTYHFRIRYASSASFSFVISEEYGRFPTTTVPLLSTMSPLPQNTPFEAFKTVDLPSTVTIRYTSAASTTFQLNFRFTVPGSANVLIDRIEFVPIEGSLFEYETKQQLEKARKAVNHLFTDGSKKALKEDTTDYEIDQAANVVDCISDECGHEKMILLDEVKYAKQLSQARNLLLNGNFDDLYPALERENPWKTSPNVTIRQDNPIFKGHYLSMAGANDIEATNDTFPTYVYQKIDEAKLKPYTRYKVRGFVGSSKDLELLVTRYNEEVDAILDVPDNIPHAPTPVCGEFDRCKPYSYPPLLPECNPEFINQMQPSSCHHNQMVDYNNMNTSTSTTMNPSMNPPLTPEIASSQSGFGRKHRKCHQAHQFEFHIDTGTIDLVEDLGIWVIFKICATDGYASLDDLEVIEEGALGVEALELVKKREKKWRHQKEQHCSQTKHKYDAAKHAVMALFTNTRYEKLKFETTISDILYADHLVQSIPYVYNKYVPEVSGMNYELYTELNTLVQNAFYLYDQRNLIKNGRFSNGLMYWQATPHARVEQEYDRSVLVLPNWDANVSQQLCIEHNRGYVLRVTARKEDPGAGNVTFSDCANHVDKLSFTSCDIATNAVPGAQANDPAAGVAYGQQGCQIDRVPYGPSGYRADGVAYEQSGHRTDGVPYRQSGYRADGVAHDQPGYRADGVAYEQSGYRADGVAYEQSGHRADGVPYGQSGYGTDGVTYDQSAKQTRKYHGCHTDGLPHPEHGCCYPDRVSDGQQLAYVTKSIDLFPDTDKVRIDIGETEGNFRVESVELICMEK

SEQ ID NO: 382 - protein, 405 aa, Paenibacillus lentimorbus semadara
MNQYHNQNDNKSYNQSGNEMQIIQPSSNALLYSPNKYPYATDPNVIAEGRSYKNWLDMCTGTGDTRSPEAAAISKGAVSAAITISTGLLGLLGVPFASQIGAFYTFLLNTLWPASNTQWEQFIAHVEELINAKLTDHVRNSALTKLNGLRNNIEIYNEALIVWKQDPNNSKLKDDVRSKFVGLNSQFEEYIPQFKEEGFEVQLLTIYAQSANLHLLLLRDSSLYGASWGFAQATIDNNYNRQIRKTAEYANHCTTWYQTGLQRLQGTTASSWLSYHRFRREMTLTVLDICALFSNYDARSYPLEVRGELTREIYTDPVAPGTNWIDRAPSFAEIENLVIRAPRTVTWISGDLIVYTGRLYGYTGNNDYWAAHRLDFLETNGYRFEGPTYGSTINISRTDSIPMNS

SEQ ID NO: 383 - protein, 686 aa, Bacillus thuringiensis entomocidus INA288
MNSYQNKNEYEILNAPSNNTNMPNRYPFANDPNAMMKNGNYKDWLDICNPEYRYSNPEAYRNTKAAMSFGVGLVSTILGVLGGPISVTLGAIIGVVTAVLEFIPADEYDNTKETWGVLIAAIKELIYEEIKGEAMNAAKAKLDGLYKVMKNYDNKLNVWKNGDKSPVEQNEIQRVFADTNNSFLLLISQFQQLGHEVSFLPLFAVAANFHLLLLRDVSIYGKEWGYTNNIIEGYHSDQLDMTQDYTNYAVDTYNKGLEEAKKIKNSDKLDWDFYNQYRRDMTLTVLDVIALFPTYDVRKYPISTKVELTREIYTDMINYINNPFMTNPVEGQRFAGYTVAQFNSIENALTREPHLFTWLKEVTGYFYAQYGQQSFMTGIQNTSYRTNYEDYPFSGPLHGVRYAGDTARSVDNNGKDVYSIYSTMFPLETNNHVHELRPGTAYYFGVKGHRHDATDRRTGNSSQKILGEDSKTGRIATGPSYFISEIPYYDKETNETIRPTPEKYNHRLSYISAYATDCGRISGVRGDGCFRTPQMCAWTHVSADPYNTIHPDKITQISAVKAFYIWDTGEGQVVSGPGFTGGDLVKLPYNARLKIRLKPTSTSKKYRVRVRYASMGAGTLRAEKWSPYGSVFSNFAYEYTGDSNKFNNFKYLETLSESFNISGVEIIIQNLSSSQLIVDKLEFIPI

SEQ ID NO: 384 - protein, 275 aa, Bacillus thuringiensis 89-T-34-22
MAIINLANELAIWAKRWCAARGYTYLVSGLQAHTGNYGRIYNYNMSVPDPIVTDNPTNAAMARGTTPNPTSQPIIRTISFNETLTDSQSTATEHGITAGAEVTVKSEAGLIFAKVGFEVKVSFQYNYTTTNTYTTETSRSWTDSLQITVPPGYVTEHTFIVQTGPYSKNVVLEADIAGHGWFNYSAPGYTGTGIVNITQVLYDNKVPGVTPYPDNFYARFRGSGKLEGKMGLQSFVNLVERPLLGRAGQVREYQIPVSLPSGLDIPIFDPVVSLQ

SEQ ID NO: 385 - protein, 338 aa, Bacillus thuringiensis dakota
MYNDKRMCSDPYQGMNKPHYCNCHTYNNSEITGGLQVDLDNQVVETFQSTTDVIREYLMFNELSALSSSPESVRSRFSSIYGTNPDGIALNNETYFNAVKPPITAQYGYYCYKNVGTVQYVNRPTDINPNVILAQDTLTNNTNEPFTTTITITGSFTNTSTVTSSTTTGFKFTSKLSIKKVFEIGGEVSFSTTIGTSETTTETITVSKSVTVTVPAQSRRTIQLTAKIAKESADFSAPITVDGYFGANFPKRVGPGGHYFWFNPARDVLNTTSGTLRGTVTNVSSFDFQTIVQPARSLLDEQQETLEYAIPGDPSGEQLQQMEQRMFFSKCQCPKWGN

SEQ ID NO: 386 - protein, 338 aa, Bacillus thuringiensis A1470
MYNDKRMCSDPYQGMNKPHYCNCHTYNNSEITGGLQVDLDNQVAETFQSTTDVIREYLMFNELSALSSSPESVRSRFFSIYGTNPDGIALNNETYFNAVKPPITAQYGYYCYKNVGTVQYVNRPTDINPNVILAQDTLTNNTNEPFTTTITITGSFTNTSTVTSSTTTGFKFTSKLSIKKVFEIGGEVSFSTTIGTSETTTETITVSKSVTVTVPAQSRRTIQLTAKIAKESADFSAPITVDGYFGANFPKRVGPGGHYYWFNPARDVLNTTSGTLRGTVTNVSSFDFQTIVQPARSLLDEQQETLEYAIPGDPSGEQLQQMEQRMFFSQCQCPKWGN

SEQ ID NO: 387 - protein, 304 aa, Bacillus thuringiensis
MYYTTQVTGGFQADLNNQVVETFQPSTNVIQEYLTFNDLPALGSSPQSVRSRFSSIYGTNPDGIALNNETYFSAVQPPITVQYGHYCYKNVGTVQYVNRPTDINPNVILAQDTLTNNTNEPFTTTITLTGSWTKSSTVTSSTTTGLKITTKLSIKKVFEIGGEVSFSTTIGSSEATSETFTVSKAVTVTVPAQSRRNIQLTAKIARESADFSAPITVDGYFGANFPRRVGPGGHYFWFNPARDVLNATSGTLRGTVTNVSSFDFQTVVQPAYSLLAEQQEALESAISGDPSEEQLKQIQQTIGL

SEQ ID NO: 388 - protein, 1134 aa, Bacillus thuringiensis CAA890
MNSNDSQNHDKLEICSNASLLSTPPYKTEYYEGEVLMDTIPFSSGKSAAQMGTSIVGQILGVLGVPFALQVTNLYSSLLDTLWPDGKSQWEIFMEQVEEIVDQKIENYARNKALAELEGLGNNFEVYLEALENWQSNTRDINDVKIRFISLDSLFTQSMPSFRIEGFQLPLLSVYAQAANLHLLLLRDATTFGKEWGLDSATMDSYYKRQKALSAEYSDHCVKWYKNGLNKLSKSTAKDWVKFNQFRREMTLTVLDVVALFPNYDAKIYPMQTVTQLTREVYTDPVGMTNLPNGIGSWYDIAPTFATIENAVIRKPHLFDFIRNLYVYFGDRGASANRSMKFWNGHEIFYANIGSSVFFQVYNYVKLGSNNYPYVFVDRDIYQTESLAGCIYDIIYPGYTYKFFGAPKVEFHVVDRRNNTGIFTFNPGFGQIIQNVQNSLSQLPLESLDEPAYEAYSHRLCHVTLVPPGNNSNYEGLPVYSWTHKSASLENVIYPDKITQIPAVKSFPGGQWGGVEAGPGFTGGDVTKSVTSEATTILRDVVKLAVTIPQDSIKQKYRVRIRYASQTDIPATFFTSDSGNRDFVLKSTTTAASNAFENYKEFQYIDIPGTIEFTKVNEIVTVYLHAYKVSNHHVNIDKVEFIPVDNNFEARKQLETSEFFAKKLLDTTKESLDREVTDYQIDYTAKLVECVSDELYPMEKQELLNIVTTAKKLSQDRNLLQDIDFSAINRENGWIGSRGIEGTEGNINFKSRSVRLPGARNIDGKIDSTYFYQKINASKLKPYTRYELRGRIESSKKLEIYLIHHNANRIIKNVNGNNSLLNSYNEIDPCISKCSNHILSIEEAELDMNNHTNFHEFSLCIDTGELDLNKNIGIWVAFKISDLNGYAELRNIECIEVEPLFGEALEKLKKQEQEWTRTENKQYEESKKIRAVAIKAVEQLFEDSSYQKLRPELDLSNISKAENLVNSIPYVSNDWFSYVPGINHNTVEELKTKIQLAFALYRHRNSIQNGDFKNGLNSWTVTSDVVVEENQIDPELVISNWSSQVSQDVVVEANHRYLLRVTAKKENVGIGYITIHDSTDNSKSIVFDDCEKNQDHYVTKTTEFIPSTDKVYIKIHETDGIFRIKNIDFTLNKK

SEQ ID NO: 389 - protein, 1177 aa, Lysinibacillus sphaericus IAB59
MDINNNNEKEIINSHLLPYSLLKKYPIKSLQSTNYKDWLNLCQDFNKDIESYDLVTAVSSGTIVVGTMLSAIYAPALIAGPIGIIGAIIISFGTLLPLLWNESENNPKTTWIEFIRMGEQLVDKTISQTVFNILESYLKDLKVNLVDYEKAKQDWIELKKQQLPGSPPSTKLRNAADIAHQRLDSLHNKFAELNKFKVEPYETILLPVYAQAANLHLNLLQQGAMFADQWIEDKYSSRNDTFAGNSNDYQNLLKSRTITYINHIENTYQNGLNYLWNQPEMTWDIYNEYRTKMTITALDLMALFPFYNKELYDPTVGIKSELTREIFINTPVEPHLHRYFKLSETEEKLTNNSDLFKWLTSLKFRTLYQPGFPFLIGNMNSFTNTNGTQLINNQQQLWSFPGTTENEEKLFPSPANIDQVTMYIYYGSGWGIPEPISTTINKLIFNHDKHELISEYDAGNTNAPTRSLSLGLPNHYLSCLNSYYPLTATTDGMNKEELKMYSFGWTHNSVDFLNEISKDKITQIPAVKAYRLTSNSRVIKGPSHIGGNLVYLSENSQMALTCRYTNSSPQEYKIRIRYASNRLNMGQLFTTFSSHQFVLPPTFNHFNIEQAKYEDYAYAEFPESMSIRGNLNSDILLILNILAGGELLLDKIEFIPLTQKVKDNLEKEKIDMLKNLTDSLFNSPSKDTLKIDSTDYQIDQIAFQIESINEEINPQEKMELLDNIKYAKKLNQLRNLLYSRESQAQIDWVTSNDVSIYHGKKPFNDYTLVMSRTSSSLSEITATNYQTYIYKKIEESKLKPYTRYLVRGFISNSEDLEIFISRYENEIHTNMNVHGDDDTLLNSDIRQNECESKLPIIFDATSQYSLSPSRTSGISNHSYYNNGHQSSCNDTHIFSFSIDTGEVDFNNYPGIEILFKLSNTNGYASISNLEVIEERLLTEEEKRQIIQIENRWKAKKESQRNETEKITTQAQQAINSLFTDTQYSNLKFETTKQNITEANTILENIPYVYNALLPTEPGMNFVLFNSFKDQINKAHALYKMRNLIKNGDFINDTKYWSISTDVKLEKVNKETILVLSSWEAQASQQILVQKQKRYLLRVIAKKEDMGRGNVIISDCLNNIAKIDFTPHDCNMNHIQNSSEFIIKTIHFSPNTEQVRIDIGQSDGVFKVESIELICVNY

SEQ ID NO: 390 - protein, 1177 aa, Lysinibacillus sphaericus 47-6B; identical to SEQ ID NO: 389

SEQ ID NO: 391 - protein, 1177 aa, Lysinibacillus sphaericus NHA15b; identical to SEQ ID NO: 389

SEQ ID NO: 392 - protein, 1129 aa, Lysinibacillus sphaericus LP1G
MDINNNNEKEIINSHLLPASLLKKHPIKSLQSTNYKDWLNLCQDFNKDIESYDLVTAVSSGTIVVGTMLSAIYAPAIIAGPIGVIGAIIISFGTLLPLLWSEDENNPKTVWIEFIRMGERLVDKTISQTVLNILESYLKDLKVNLIDYEKAKQDWIELKKQQLPGSPPSINLRNAADIAHQRLDSLHNKFAELNVFKVASYETILLPVYAQAANLHLNLLQQGAMFADQWIEDKYSPRNDTFAGNSNDYQDLLKSRTITYINHIENTYKDGLNYLWNQPEMTWDIYNEYRTNMTLTALDLLPLFPFYNKELYDPRVGIKSELTREVYINTPVDPHLHRYFKLGETEDKLTNNSELFKWLTSLKFRTFNQPGFPFLIGNMNYFKKTNGTQLINNQQQLWSFPGTTEIEKLFPSPANIDKVTMYIYYGSGWEVPEPISITINKLIFNHHKHGLITEYDAGNTNAPTMGIYVNLPKHYLSCLNSYYPLTATTNGMGKEELKMYSFGWTHESVDFLNEISNDKITQIPAVKAYNLNSNSRVIKGPGHIGGNLVYLSDKSQLSLACRYTNSSPQDFLIRIRYASNKRNMVQLFTPFSTHQFVLPQTFNHLNIEQTKYEDYEYAQLPGSLTINGNVNIDLLFLLNVLDGGELLLDKIEFIPLTQKVKDNLEKEKIDMLKNLTDSLFNSPAKDTLKINSTDYQIDQIAFQIESINEEINTQEKMKLLDNIKYAKKLNQLRNLLYSRESQAQIDWVTSNDVSIYHGKKPFNEYTLVMSGSSLSKITSSNYPTYIYKKIEESKLKPYTRYLVRGFISNSDNLEIFISRYENEIHTNMNVHVDDDTLLNSYKRQNECESKLPIVFDETSQYPLSPSRTSGISNHSYYNGAQQSSCHDTQIFSFSIDTGDVDFNEYPGIEILFKLSNSNGYASISNLEVIEERLLTEEEKRHIIEIENRWKAKKEIQRNETEKETTQAQQAINNLFTDTQYSKLKFETTKQSISKANAILENIPYVYNSLLPTEPGMNFELFNSFKDQINKAHTLYKMRNSIKNGDFINGTEYWSISTDVKLEKTNIETILVMSSWSAQSSQQILVQKQNRYLLRVIAKKEDMGSGNVTISDCLNNIAKIEFIPHDCNMN

SEQ ID NO: 393 - protein, 1129 aa, Lysinibacillus sphaericus 2173
MDINNNNEKEIINSHLLPASLLKKHPIKSLQSTNYKDWLNLCQDFNKDIESYDLVTAVSSGTIVVGTMLSAIYAPAIIAGPIGVIGAIIISFGTLLPLLWSEDENNPKTVWIEFIRMGERLVDKTISQTVLNILESYLKDLKVNLIDYEKAKQDWIELKKQQLPGSPPSINLRNAADIAHQRLDSLHNKFAELNVFKVASYETILLPVYAQAANLHLNLLQQGAMFADQWIEDKYSPRNDTFAGNSNDYQDLLKSRTITYINHIENTYKDGLNYLWNQPEMTWDIYNEYRTNMTLTALDLLPLFPFYNKELYDPRVGIKSELTREVYINTPVDPHLHRYFKLGETEDKLTNNSELFKWLTSLKFRTFNQPGFPFLIGNMNYFKKTNGTQLINNQQQLWSFPGTTEIEKLFPSPANIDKVTMYIYYGSGWEVPEPISITINKLIFNHHKHGLITEYDAGNTNAPTMGIYVNLPKHYLSCLNSYYPLTATTNGMGKEELKMYSFGWTHESVDFLNEISNDKITQIPAVKAYNLNSNSRVIKGPGHIGGNLVYLSDKSQLSLACRYTNSSPQDFLIRIRYASNKRNMVQLFTPFSTHQFVLPQTFNHLNIEQTKYEDYEYAQLPGSLTINGNVNIDLLFLLNVLDGGELLLDKIEFIPLTQKVKDNLEKEKIDMLKNLTDSLFNSPAKDTLKIDSTDYQIDQIAFQIESINEEINTQEKMKLLDNIKYAKKLNQLRNLLYSRESQAQIDWVTSNDVSIYHGKKPFNEYTLVMSGSSLSKITSSNYPTYIYKKIEESKLKPYTRYLVRGFISNSDNLEIFISRYENEIHTNMNVHVDDDTLLNSYKRQNECESKLPIVFDETSQFPLSPSRTSGISNHSYYNGAQQSSCHDTQIFSFSIDTGDVDFNEYPGIEILFKLSNSNGYASISNLEVIEERLLTEEEKRHIIEIENRWKAKKEIQRNETEKETTQAQQAINNLFTDTQYSKLKFETTKQSISKANAILENIPYVYNSLLPTEPGMNFELFNSFKDQINKAHTLYKMRNSIKNGDFINGTKYWSISTDVKLEKTNIETILVMSSWSAQSSQQILVQKQNRYLLRVIAKKEDMGSGNVTISDCLNNIAKIEFIPHDCNMN

SEQ ID NO: 394 - protein, 464 aa, Lysinibacillus sphaericus IAB59
MENQIKEEFNKNNHGIPSDCSCIKEGDDYNSLTEINAKEFSYCSPNMFNLNLPEQSTRFQTIASIHSNNCSFEILNNDPGYIYGDSVDGECRIAVAHRELGNGLERTGDDRFLFIFYALDNNNFIIANRHDGFVLQFLIANGQGVIVSREYQPNIHQEFTIQSINSDTFRLHSRDTNTFATVCWAQFNSWTKIVSRVDNPGAPNANLKHRSLLTDINMPQLPSLTPLQPLPRLTELEDGGLSPAQAPRAIIGRTLIPCLFVNDPVLRLENRIKQSPYYVLEHRQYWHRIWTDIFTAGERREYREVTGINNNAQNDMNKMINITIGADGPNRLRFGNLSTPFRQQIIDNSNTLGSFANTNYGTRTDIVNVFNSEFHQVRYARFVKAYEYRLTRADGSQVGTPWVVLDRKEMDLRTYPHNMAITLENVKIDNADNSYDLSIWKTPLKLKDGKIIIENHENSKPYYN

SEQ ID NO: 395 - protein, 464 aa, Lysinibacillus sphaericus 47-6B; identical to SEQ ID NO: 394

SEQ ID NO: 396 - protein, 464 aa, Lysinibacillus sphaericus NHA15b; identical to SEQ ID NO: 394

SEQ ID NO: 397 - protein, 464 aa, Lysinibacillus sphaericus 2173; identical to SEQ ID NO: 394

SEQ ID NO: 398 - protein, 467 aa, Lysinibacillus sphaericus LP1G
MENQIKEEFNKNNHGIPSDCSCIKEGDDYNSLTEVPSEINAKEFSYCSPNMFNLNLPEQSTRFQTIGSIHSNNCSFEILNNDPGYIYGDSVAGECRIAVAHRELGNGLERTGDDRFLFIFYALDNNNFIIANRHDGFVLQFLIANGQGVIVSREYQPNIRQEFTIQSINSDTFRLHSRDTNTFATVCWAQFNSWTKIVSRVDNPGAPNADLRHRSFLDINMPQLPSLTPLQPLPRLTGLEDGGLSPAQAPRAIIGRTLIPCLFVNDPVLRLESRIKQSPYYVLEHRQYWHRLWTDIFNAGERREYREVTGINHNAQNDMNNMINITIGSDGPNRLLFGHLSTPFRQQIISNSNTLGSFANSNYSSRTESITYLNTEFHQVRFARFVKAYEYRLTRADGTLVGTPWVVLDRKEMDLRTFPHNMTLNLENVKIVNADNSYDLSVWKTPLKLKDGKIIIENHENSKPYYN

SEQ ID NO: 399 - protein, 1180 aa, Bacillus thuringiensis israelensis
MNPYQNKNEYETLNASQKKLNISNNYTRYPIENSPKQLLQSTNYKDWLNMCQQNQQYGGDFETFIDSGELSAYTIVVGTVLTGFGFTTPLGLALIGFGTLIPVLFPAQDQSNTWSDFITQTKNIIKKEIASTYISNANKILNRSFNVISTYHNHLKTWENNPNPQNTQDVRTQIQLVHYHFQNVIPELVNSCPPNPSDCDYYNILVLSSYAQAANLHLTVLNQAVKFEAYLKNNRQFDYLEPLPTAIDYYPVLTKAIEDYTNYCVTTYKKGLNLIKTTPDSNLDGNINWNTYNTYRTKMTTAVLDVVALFPNYDVGKYPIGVQSELTREIYQVLNFEESPYKYYDFQYQEDSLTRRPHLFTWLDSLNFYEKAQTTPNNFFTSHYNMFHYTLDNISQKSSVFGNHNVTDKLKSLGLATNIYIFLLNVISLDNKYLNDYNNISKMDFFITNGTRLLEKELTAGSGQITYDVNKNIFGLPILKRRENQGNPTLFPTYDNYSHILSFIKSLSIPATYKTQVYTFAWTHSSVDPKNTIYTHLTTQIPAVKANSLGTASKVVQGPGHTGGDLIDFKDHFKITCQHSNFQQSYFIRIRYASNGSANTRAVINLSIPGVAELGMALNPTFSGTDYTNLKYKDFQYLEFSNEVKFAPNQNISLVFNRSDVYTNTTVLIDKIEFLPITRSIREDREKQKLETVQQIINTFYANPIKNTLQSELTDYDIDQAANLVECISEELYPKEKMLLLDEVKNAKQLSQSRNVLQNGDFESATLGWTTSDNITIQEDDPIFKGHYLHMSGARDIDGTIFPTYIFQKIDESKLKPYTRYLVRGFVGSSKDVELVVSRYGEEIDAIMNVPADLNYLYPSTFDCEGSNRCETSAVPANIGNTSDMLYSCQYDTGKKHVVCQDSHQFSFTIDTGALDTNENIGVWVMFKISSPDGYASLDNLEVIEEGPIDGEALSRVKHMEKKWNDQMEAKRSETQQAYDVAKQAIDALFTNVQDEALQFDTTLAQIQYAEYLVQSIPYVYNDWLSDVPGMNYDIYVELDARVAQARYLYDIRNIIKNGDFTQGVMGWHVTGNADVQQIDGVSVLVLSNWSAGVSQNVHLQHNHGYVLGVIAKKEGPGNGYVTLMDWEENQEKLTFTSCEEGYITKTVDVFPDTDRVRIEIGETEGSFYIESIELICMNE

SEQ ID NO: 400 - protein, 1180 aa, Bacillus thuringiensis israelensis HD522
MNPYQNKNEYETLNASQKKLNISNNYTRYPIENSPKQLLQSTNYKDWLNMCQQNQQYGGDFETFIDSGELSAYTIVVGTVLTGFGFTTPLGLALIGFGTLIPVLFPAQDQSNTWSDFITQTKNIIKKEIASTYISNANKILNRSFNVISTYHNHLKTWENNPNPQNTQDVRTQIQLVHYHFQNVIPELVNSCPPNPSDCDYYNILVLSSYAQAANLHLTVLNQAVKFEAYLKNNRQFDYLEPLPTAIDYYPVLTKAIEDYTNYCVTTYKKGLNLIKTTPDSNLDGNINWNTYNTYRTKMTTAVLDLVALFPNYDVGKYPIGVQSELTREIYQVLNFEESPYKYYDFQYQEDSLTRRPHLFTWLDSLNFYEKAQTTPNNFFTSHYNMFHYTLDNISQKSSVFGNHNVTDKLKSLGLATNIYIFLLNVISLDNKYLNDYNNISKMDFFITNGTRLLEKELTAGSGQITYDVNKNIFGLPILKRRENQGNPTLFPTYDNYSHILSFIKSLSIPATYKTQVYTFAWTHSSVDPKNTIYTHLTTQIPAVKANSLGTASKVVQGPGHTGGDLIDFKDHFKITCQHSNFQQSYFIRIRYASNGSANTRAVINLSIPGVAELGMALNPTFSGTDYTNLKYKDFQYLEFSNEVKFAPNQNISLVFNRSDVYTNTTVLIDKIEFLPITRSIREDREKQKLETVQQIINTFYANPIKNTLQSELTDYDIDQAANLVECISEELYPKEKMLLLDEVKNAKQLSQSRNVLQNGDFESATLGWTTSDNITIQEDDPIFKGHYLHMSGARDIDGTIFPTYIFQKIDESKLKPYTRYLVRGFVGSSKDVELVVSRYGEEIDAIMNVPADLNYLYPSTFDCEGSNRCETSAVPANIGNTSDMLYSCQYDTGKKHVVCQDSHQFSFTIDTGALDTNENIGVWVMFKISSPDGYASLDNLEVIEEGPIDGEALSRVKHMEKKWNDQMEAKRSETQQAYDVAKQAIDALFTNVQDEALQFDTTLAQIQYAEYLVQSIPYVYNDWLSDVPGMNYDIYVELDARVAQARYLYDTRNIIKNGDFTQGVMGWHVTGNADVQQIDGVSVLVLSNWSAGVSQNVHLQHNHGYVLRVIAKKEGPGNGYVTLMDCEENQEKLTFTSCEEGYITKTVDVFPDTDRVRIEIGETEGSFYIESIELICMNE

SEQ ID NO: 401 - protein, 1180 aa, Bacillus thuringiensis israelensis; identical to SEQ ID NO: 400

SEQ ID NO: 402 - protein, 1180 aa, Bacillus thuringiensis s. israelensis BRC-LLP29; identical to SEQ ID NO: 400

SEQ ID NO: 403 - protein, 145 aa, Bacillus thuringiensis LDC-9
SSLNFQQSYFIRIRYASNGSANTRAVINLSIPGVAELGMALNPTFSGTDYTNLKYKDFQYLEFSNEVKFAPNQNISLVFNRSDVYTNTTVLIDKIEFLPITRSIREDREKQKLETVQQIINTFYANPIKNTLQSELTDYDIDQGG

SEQ ID NO: 404 - protein, 1136 aa, Bacillus thuringiensis israelensis 4Q2-72
MNSGYPLANDLQGSMKNTNYKDWLAMCENNQQYGVNPAAINSSSVSTALKVAGAILKFVNPPAGTVLTVLSAVLPILWPTNTPTPERVWNDFMTNTGNLIDQTVTAYVRTDANAKMTVVKDYLDQYTTKFNTWKREPNNQSYRTAVITQFNLTSAKLRETAVYFSNLVGYELLLLPIYAQVANFNLLLIRDGLINAQEWSLARSAGDQLYNTMVQYTKEYIAHSITWYNKGLDVLRNKSNGQWITFNDYKREMTIQVLDILALFASYDPRRYPADKIDNTKLSKTEFTREIYTALVESPSSKSIAALEAALTRDVHLFTWLKRVDFWTNTIYQDLRFLSANKIGFSYTNSSAMQESGIYGSSGFGSNLTHQIQLNSNVYKTSITDTSSPSNRVTKMDFYKIDGTLASYNSNITPTPEGLRTTFFGFSTNENTPNQPTVNDYTHILSYIKTDVIDYNSNRVSFAWTHKIVDPNNQIYTDAITQVPAVKSNFLNATAKVIKGPGHTGGDLVALTSNGTLSGRMEIQCKTSIFNDPTRSYGLRIRYAANSPIVLNVSYVLQGVSRGTTISTESTFSRPNNIIPTDLKYEEFRYKDPFDAIVPMRLSSNQLITIAIQPLNMTSNNQVIIDRIEIIPITQSVLDETENQNLESEREVVNALFTNDAKDALNIGTTDYDIDQAANLVECISEELYPKEKMLLLDEVKNAKQLSQSRNVLQNGDFESATLGWTTSDNITIQEDDPIFKGHYLHMSGARDIDGTIFPTYIFQKIDESKLKPYTRYLVRGFVGSSKDVELVVSRYGEEIDAIMNVPADLNYLYPSTFDCEGSNRCETSAVPANIGNTSDMLYSCQYDTGKKHVVCQDSHQFSFTIDTGALDTNENIGVWVMFKISSPDGYASLDNLEVIEEGPIDGEALSRVKHMEKKWNDQMEAKRSETQQAYDVAKQAIDALFTNVQDEALQFDTTLAQIQYAEYLVQSIPYVYNDWLSDVPGMNYDIYVELDARVAQARYLYDTRNIIKNGDFTQGVMGWHVTGNADVQQIDGVSVLVLSNWSAGVSQNVHLQHNHGYVLRVIAKKEGPGNGYVTLMDCEENQEKLTFTSCEEGYITKTVDVFPDTDRVRIEIGETEGSFYIESIELICMNE

SEQ ID NO: 405 - protein, 1136 aa, Bacillus thuringiensis israelensis
MNSGYPLANDLQGSMKNTNYKDWLAMCENNQQYGVNPAAINSSSVSTALKVAGAILKFVNPPAGTVLTVLSAVLPILWPTNTPTPERVWNDFMTNTGNLIDQTVTAYVRTDANAKMTVVKDYLDQYTTKFNTWKREPNNQSYRTAVITQFNLTSAKLRETAVYFSNLVGYELLLLPIYAQVANFNLLLIRDGLINAQEWSLARSRGDQLYNTMVQYTKEYIAHSITWYNKGLDVLRNKSNGQWITFNDYKREMTIQVLDILALFASYDPRRYPADKIDNTKLSKTEFTREIYTALVESPSSKSIAALEAALTRDVHLFTWLKRVDFWTNTIYQDLRFLSANKIGFSYTNSSAMQESGIYGSSGFGSNLTHQIQLNSNVYKTSITDTSSPSNRVTKMDFYKIDGTLASYNSNITPTPEGLRTTFFGFSTNENTPNQPTVNDYTHILSYIKTDVIDYNSNRVSFAWTHKIVDPNNQIYTDAITQVPAVKSNFLNATAKVIKGPGHTGGDLVALTSNGTLSGRMEIQCKTSIFNDPTRSYGLRIRYAANSPIVLNVSYVLQGVSRGTTISTESTFSRPNNIIPTDLKYEEFRYKDPFDAIVPMRLSSNQLITIAIQPLNMTSNNQVIIDRIEIIPITQSVLDETENQNLESEREVVNALFTNDAKDALNIGTTDYDIDQAANLVECISEELYPKEKMLLLDEVKNAKQLSQSRNVLQNGDFESATLGWTTSDNITIQEDDPIFKGHYLHMSGARDIDGTIFPTYIFQKIDESKLKPYTRYLVRGFVGSSKDVELVVSRYGEEIDAIMNVPADLNYLYPSTFDCEGSNRCETSAVPANIGNTSDMLYSCQYDTGKKHVVCQDSHQFSFTIDTGALDTNENIGVWVMFKISSPDGYASLDNLEVIEEGPIDGEALSRVKHMEKKWNDQMEAKRSETQQAYDVAKQAIDALFTNVQDEALQFDTTLAQIQYAEYLVQSIPYVYNDWLSDVPGMNYDIYVELDARVAQARYLYDTRNIIKNGDFTQGVMGWHVTGNADVQQIDGVSVLVLSNWSAGVSQNVHLQHNHGYVLRVIAKKEGPGNGYVTLMDCEENQEKLTFTSCEEGYITKTVDVFPDTDRVRIEIGETEGSFYIESIELICMNE

SEQ ID NO: 406 - protein, 1135 aa, Bacillus thuringiensis israelensis
MNSGYPLANDLQGSMKNTNYKDWLAMCENNQQYGVNPAAINSSSVSTALKDAGAILKFVNPPAGSVLTVLSAVLPILWPTNTPTPERVWNDFMTNTGNLIDQTVTAYVRTDANAKMTVVKDYLDQYTTKFNTWKREPNNQSYRTAVITQFNLTSAKLRETAVYFSNLVGYELLLLPIYAQVANFNLLLIRDGPHKCTRMVYARSCDQLYNTMVQYTKEYIAHSITWYNKGLDVLRNKSNGQWITFNDYKREMTIQVLDILALFASYDPRRYPADKIDNTKLSKTEFTREIYTALVESPSSKSIAALEAALTRDVHLFTWLKRVDFWTNTIYQDLRFLSANKIGFSYTNSSAMQESGIYGSSGLVQIYLIKFNLILIVIKLLSQILAPPLIELQKWISTKFDGTLASYNSNITPTPEGLRTTFFGFSTNENTPNQPTVNDYTHILSYIKTDVIDYNSNRVSFAWTHNIVDPNNQIYTDAITQVPAVKSNFLNATARVIKGPGHTGGDLVALTSNGTLSGGRMEIQCKTSIFNDPTRSYGLRIRYAANSPIVIECDHMYYKEFLEEQRLVQNYVSRPNNIIPTDLKYEEFRYKDPNDAIVPMRLSSNQLITIAIQPLNMTSNNQVIIDRIEIIPITQSVLDETENQNLESEREVVNALFTNDAKDALNIGTTDYDIDQAANLVECISEGIISKEKMLLLDEVKNAKQLSQSRNVLQNGDFESRTLGWTTSDNITIQEDDPIFKGHYLHMSGARDIDGTIFPTYIFQKIDESKLKPYTRYLVRGFVGSSKDVELVVSRYGEEIDAIMNVPADLNYLYPSTFDCEGLIVVSVRCAANIWDTSDMLYSCQYDTGKKHVVCQDSHQFSFTIDTGALDTNENIGVWVMFKISSPDGYASLDNLEVIERGPIDGEALSRVKHMEKKWNDQMEAKRSETQQAYDVAKQAIDALFTNVQDEALQFDTTLAQIQYAEYLVQSIPYVYNDWLSDVPGMNYDIYVELDARVAQARYLYDTRNIIKNVDFTQGVMGWHVTGNADVQQIDGVSVLVLSNWSAGVSQNVHLQHNHGYVLRVIAKKEGPGNGYVTLMDCEENQEKLTFTSCEEGYITKTVDVFPDTDRVRIEIGETEGSFYIESIELICMNE

SEQ ID NO: 407 - protein, 1135 aa, Bacillus thuringiensis israelensis HD522
MNSGYPLANDLQGSMKNTNYKDWLAMCENNQQYGVNPAAINSSSVSTALKVAGAILKFVNPPAGTVLTVLSAVLPILWPTNTPTPERVWNDFMTNTGNLIDQTVTAYVRTDANAKMTVVKDYLDQYTTKFNTWKREPNNQSYRTAVITQFNLTSAKLRETAVYFSNLVGYELLLLPIYAQVANFNLLLIRDGLINAQEWSLACAGDQLYNTMVQYTKEYIAHSITWYNKGLDVLRNKSNGQWITFNDYKREMTIQVLDILALFASYDPRRLPADKIDNTKLSKTEFTREIYTALVESPSSKSIAALEAALTRDVHLFTWLKRVYFWTNTIYQDLRFLSANKIGFSYTNSSAMQESGIYGSSGFGSNLTHQIQLNSNVYKTSITDTSSPSNRVTKMDFYKIDGTLASYNSNITPTPEGLRTTFFGFSTNENTPNQPTVNDYTHILSYIKTDVIDYNSNRVSFAWTHKIVDPNNQIYTDAITQVPAVKSNFLNATAKVIKGPGHTGGDLVALTSNGTLSGRMEIQCKTSIFNDPTRSYGLRIRYAANSPIVLNVSYVLQGVSRGTTISTESTFSRPNNIIPTDLKYEEFRYKDPFDAIVPMRLSSNQLITIAIQPLNMTSNNQVIIDRIEIIPITQSVLDETENQNLESEREVVNALFTNDAKDALNIGTTDYDIDQAANLVECISEELYPKEKMLLLDEVKNAKQLSQSRNVLQNGDFESATLGWTTSDNITIQEDDPIFKGHYLHMSGARDIDGTIFPTYIFQKIDESKLKPYTRYLVRGFVGSSKDVELVVSRYGEEIDAIMNVPADLNYLYPSTFDCEGSNRCETSAVPANIGNTSDMLYSCQYDTGKKHVVCQDSHQFSFTIDTGALDTNENIGVWVMFKISSPDGYASLDNLEVIEEGPIDGEALSRVKHMEKKWNDQMEAKRSETQQAYDVAKQAIDALFTNVQDEALQFDTTLAQIQYAEYLVQSIPYVYNDWLSDVPGMNYDIYVELDARVAQARYLYDTRNIIKNGDFTQGVMGWHVTGNADVQQIDGVSVLVLSNWSAGVSQNVHLQHNHGYVLRVIAKKEGPGNGYVTLMDCEENQEKLTFTSCEEGYITKTVDVFPDTDRVRIEIGETEGSFYIESIELICMNE

SEQ ID NO: 408 - protein, 1136 aa, Bacillus thuringiensis israelensis; identical to SEQ ID NO: 404

SEQ ID NO: 409 - protein, 79 aa, Bacillus thuringiensis LDC-9
MKSLHKDPFEAIVPMTLSSNQLITIAIQPLNMTSNNQVIIDRIEIIPITQSVLDETENQNLESEREVVNALFTNDAKDA

SEQ ID NO: 410 - protein, 1230 aa, Bacillus thuringiensis Y41
MNSYENKNEYEILDASQNNSNMSNRYQRYPLAHNPQTSIQTTNYKDWLRMCENPLDMEGYDSNSVVVVSTGLIVVGTLISILSAGLGSIPIIYGTLLPVLWNDPNNPQKTWHEFMSHGETLLNQTISTVERNRAAAYLEGYTTAVKKCEEALNVWLKTPNQANARTVADLYKDTDFLFFTTLPHLKLRGYETLLLSSYTQAANMHLILLKQASKYADQWNAQLSVSVQKTANDYYTDLVKLIGEYTDYCIATYRLGLTTIKSRATSWNIYNMYRREMTILVLDLVALFPAHDIKKYPSGTKVELTREIYTDALGAVALPQNIDATEQLATRAPNLFSWLKGFKFITTQSTNRYYLSGIANQYSFTNSNGEIWGPISGNPTGVSSDLTIDNNFSIYKLSILRGYQLSPDFSFHNPVHQIDFSTTNNQQGRVQSYKSGGPTPVNPETTAIHLPIDSKCIQNCNPTFNNYSHILSYAKTFTSNLTIGTTANITSFGWTHNSVDRENTIDLNNITQIPAVKASQVYPENSVIKGPGHTGGNLVRIDSSGYMSIVCKFPLQVKGYRVRIRYAANNRAELYISSAGNSPSKNVDLDPTFSGTNYESLNYTNFKDKETEFIITEGQLVKQSIIFSTNGNVLLDKIEFIPLGTTTYEYEEKQNLEKAQKALNALFTDSTNGYLQMDTTDYDINQTASLIECVSDELYAKEKIVLLDEVKYAKRLSISRNLLLKDDLEFSAGFGENGWTTSDNISIQADNPIFKGNYLKMFGARDIDGILFPTYLYQKIEESKLKPYTRYRVRGFVGSSKDLKLVVTRYEKEIDAIMNVPNDLAHMQLNPSCGDYRCESSSQFLVNQVHPTPTAGYALDRYARPSSSDKKHIMCHDRHPFDFHIDTGELNPNTNLGIDVLFKISNPNGYATLGNLEVIEEGPLTDEALVHVKQKEKKWRQHMEKKRMETQQAYDPAKQAVDALFTNEQELDYHITLDYIKNADQLVQAIPYVHHAWLPDAPGMNYDVYQGLNARIMQAYNLYDARNIIINGDFTQGLQGWHATGKAAVQQIDGASVLVLSNWSAEVSQNLHAQDHHGYMLRVIAKKEGPGKGYVTMMDCNGKQETLTFTSCEEGYITKTIEVFPESNRIRIEMGETEGTFYVDSIELLCMQGYASNNNPHTGNMYEQSYNGNYNQNTSDVYHQGYINNYNQNSSSMYNQNYINNDDLHSGCTCNQGHNSGCTCNQGYNR

SEQ ID NO: 411 - protein, 1157 aa, Bacillus thuringiensis HS18-1
MNSYQNKNEYEILDASQNNSNMSNRYQRYPLAHNPQTSIQTTNYKDWLKMCQNPHQNPLDMEGYDSNSVVVVSTGLIVVGTLISILSAGLGSIPIIYGTLLPVLWNDPNNPQKTWHEFMSHGETLLNQTISTVERNRAAAYLEGYTTAVKNVKKHLNVWLKTPNQANARTVADLYKDTDFLFFTTLPHLKLRGYETLLLSSYTQAANMHLILLKQASKYADQWNAQLSVYVQKTANDYYTDLVKLIGEYTDYCIATYRLGLTTIKSRATSWNIYNMYRREMTILVLDLVALFPAHDIKKYPSGTKVELTREIYTDALGAVALPQNIDAIEQLATRAPNLFSWLKGFKFITTQSTNRYYLSGIANQYSFTNSNGEIWGPISGNPTGVSSDLTIDNNFSIYKLSILRGYQLSPDFSFHNPVHQIDFSTTNNQQGRVQSYKSGGPTPVNPETTAIHLPIDSKCTQNCNPTFNNYSHILSYAKTFTSNLTIGTTSNIHFVWLDAQSVDRENTIDLNNITQIPAVKASQVYPENSVIKGPGHTGGNLVRIDSSGYMSIVCKFPLQVKGYRVRIRYAANNRAELYISSAGNSPSKNVDLDPTFSGTNYESLNYTNFKDKETEFIITEGQLVKQSIIFSTNGNVLLDKIEFIPLGTTTYEYEEKQNLEKARKALNALFTDGTNGYLQMDTIDYDINQTANLIECVSDELYAKEKIVLLDEVKYAKRLSISRNLLSKDYLEFSDVFEENGWTTSDNISIQADNPIFKGNYLKMFGARDIDGTLFPTYLYQKIEESKLKPYTRYRVRGFVGSSKDLKLVVTRYEKEIDAIMNVPNDLAHMQLNPSCGDYRCESSSQFLVNQVHPTSTAGYALDMYACPLSSDKNHVMCHDRHPFDFHIDTGEVGTNTNVGIDVLFKISNPDGYATVGNLEVIEEGPLTGDALAHVKHKEKKWKQHMEKKRWKTQQAYDPAKQAVDALFTNEQELHYHITLDHIQNADRLIQAIPYVYHAWLPSAPGMNYDGYQGLNARIMQARYLYDARNIITNGDFTQGLTGWHAAGKATVQQMNGASVLVLSNWSAGVSQNLHVQDHHGYVLRVIAKKEGPGKGYVTMMDCNGNQETLKFTSCEEGYMTKTVEVFPESDRVRIEMGETEGTFYIDSIELICMNE

SEQ ID NO: 412 - protein, 1136 aa, Bacillus thuringiensis Ywc2-8
MSNRYQRYPLAHNPQTSIQTTNYKDWLKMCQNPHQNPLDMEGYDSNSVVVVSTGLIVVGTLISILSAGLGSIPIIYGTLLPVLWNDPNNPQKTWHEFMSHGETLLNQTISTVERNRAAAYLEGYTTAVKKCEEALNVWLKTPNQANARTVADLYKDTDFLFFTTLPHLKLRGYETLLLSSYTQAANMHLILLKQASKYADQWNAQLSVYVQKTANDYCTDLVKLIGEYTDYCIATYRLGLTTIKSRATSWNIYNMYRREMTILVLDLVALFPAHDIKKYPSGTKVEPTREIYTDALGAVALPQNIDAIEQLATRAPNLFSWLKGFKFITTQSTNRYYLSGIANQYSFTNSNGEIWGPISGNPTGVSSDLTIDNNFSIYKLSILRGYQLSPDFSFHNPVHQIDFSTTNNQQGRVQSYKSGGPTPVNPETTAIHLPIDSKCTQNCNPTFNNYSHILSYAKTFTSNLTIGTTSNITSFGWTHNSVDRENTIDLNNITQIPAVKASQVYPENSVIKGPGHTGGNLVRIDSSGYMSIVCKFPLQVKGYRVRIRYAANNRAELYISSAGNSPSKNVDLDPTFSGTNYESLNYTNFKYKETEFIITEGQLVKQSIIFSTNGNVLLDKIEFIPLGTTTYEYEEKQNLEKARKALNALFTDGTNGYLQMDTTDYDINQTANLIECVSDELYAKEKIVLLDEVKYAKRLSISRNLLSKDYLEFSDVFEENGWTTSDNISIQADNPIFKGNYLKMFGARDIDGTLFPTYLYQKIEESKLKPYTRYRVRGFVGSSKDLKLVVTRYEKEIDAIMNVPNDLAHMQLNPSCGDYRCESSSQFLVNQVHPTPTAGYALDMYACSLSSDKKHVMCHDRHPFDFHIDTGEAGTNTNVGIDVLFKISNPDGYATVGNLEVIEEGPLTGDALAHVKHKEKKWKQHMEKKRWKTQQAYDPAKQAVDALFTNEQELHYHITLDHIQNADRLIQAIPYVYHAWLPSAPGMNYDGYQGLNARIMQARYLYDARNIITNGDFTQGLTGWHAAGKATVQQMNGASVLVLSNWSAGVSQNLHVQDHHGYVLRVIAKKEGPGKGYVTMMDCNGNQETLKFTSCEEGYMTKTVEVFPESDRVRIEMGETEGTFYIDSIELICMNE

SEQ ID NO: 413 - protein, 1157 aa, Bacillus thuringiensis MC28
MNSYQNKNEYEILDASQNNSNMSNRYQRYPLAHNPQTSIQTTNYKDWLKMCQNPHQNPLDMEGYDSNSVVVVSTGLIVVGTLISILSAGLGSIPIIYGTLLPVLWNDPNNPQKTWHEFMSHGETLLNQTISTVERNRAAAYLEGYTTAVKNVKKHLNVWLTAPNQANARTVADLYKDTDFLFFTTLPHLKLRDFETLLLSSYTQAANMHLILLKQASKYADQWNAQLPVSVRKTANDYYTDLVKLIGEYTDYCIATYRSGLNTIKSRATSWNIYNMYRREMTILVLDLVALFPAYDIKKYPSGTKVELTREIYTDALGAVAIPQNIDATEQLATRAPNLFSWLKGFKFITTQSTNRYYLSGIANRYSFTNSNGEIWGPISGNPTGVSSDLTIDNNFSIYKLSILRGYQLSPDFSFHNPVHQIDFSTTNNQQGRVQSYKSGGPTPVNPETTAIHLPIDSKCTQNCNPTFNNYSHILSYAKTFTSNLTIGTTSNITSFGWTHNSVDRENTIDLNNITQIPAVKASQVYPENSVIKGPGHTGGNLVRIDSSGYMSIVCKFPLQVKGCRVRIRYAANNRAELYISSAGNSPSKNVDLDPTFSGTNYESLNYTNFKDKETEFIITEGQLVKQSIIFSTNGNVLLDKIEFIPLGTTTYEYEEKQNLEKAQKALNALFTDGTNGYLQMDATDYDINQTANLIECVSDELYAKEKIVLLDEVKYAKRLSISRNLLLNDDLEFSDGFGENGWTTSDNISIQADNPLFKGNYLKMFGARDIDGTLFPTYLYQKIDESRLKPYTRYRVRGFVGSSKNLKLVVTRYEKEIDAIMNVPNDLAHMQLNPSCGDYRCESSSQFLVNQVHPTPTAGYAPDMYACPSNSDEKHVMCHDRHPFDFHIDTGELNPNTNLGIDVLFKISNPNGYATLGNLEVIEEGPLTDEALVHVKQKEKKWRQHMEKKRMETQQAYDPAKQAVDALFTNEQELHYHITLDHIQNAGRLVQLIPYAHHAWLLDVPGMNYDVYTELNVRITQARYLYKERNVITNGDFTQGLTGWQETGKATVQQMDGASVLVLSNWSAGVSQNLHVQDQHGYVLRVTAKKEGPGKGYVTMMDCNGKQETLRFTSCEEGYMTKTVEVFPESDHVRIEMGETEGTFYIDSIEFLCMKG

SEQ ID NO: 414 - protein, 679 aa, Bacillus thuringiensis sotto
MNLYQNKNEYEILDASRNNSNMSNSYLRYPLESNPNQPLQKTNYKDWVNMCKGNPGGFLLSDEQYVAIVGTVISKLLGFVPVVGDILSFLADTYWPKIAGQEVDTRVWAGLIRHTANLISVENYQDALIKATTNLMGLYGALNVYNRFLADWKKSGMVFNGTLADELRKQMSTLHLMFTQTIIRDFSQPGYQAILLPSYTSAANLHLLLLRDIEIYGKELGFSQQVLDSYYRELILFTKEYTTHCVDTYNAALNAQKQKGWIAFNHYRRNMTLTVLDVITLFPSYDARKYPADKKDVKKLSKTELTREIYTAFLETSPNQTVEIMEASLTRDPHIFTWIKRLDFWTDTLYPDNKFLSANRNGFSYTNSSTVQESIVYGDSGFGSTLTHAIPINSNIYKVSITDTRSIPNRIPQVDFHKMDGTLTSYSSGIKLPPEELRTTFFGFSTNENTPNQPNSSDYTHILTYMKTGIISGGAPKRVSLAWAHKSVNPYNQIFTDDITQVPAVKSSLLNVQAKVIKGPGHTGGDLVALINNNLQAGRMDITCKTSNFNESERRYGLRIRYAANNSFSIYVSYVSSEGSIRQTSRIIESTFSRPNNIIPTDLKYDEFKYNEAFDAILPVRLSPNQSTTISIYQTNALPANQLIIDRIEFIPITQSVLDYTEKQNLEKSQKTVNNLFVS

SEQ ID NO: 415 - protein, 679 aa, Bacillus thuringiensis S2160-1
MNSYQNTNEYEILDASPSYSNMTNSYPRYPLANNRQGSMKNTNYKDWLAMCEGNVEGLFLTDEQMVSIVGAAISKLLGFVPVVGDILSSLADTYWPKIAGQEADTRVWAGLIRHTANLIDNRDVDRVIGQATANVMSLYAALGVYNRFLEQWKSPVKPYAGLADEIRAQMSTLHLLFTTKIISDFTIQGYEAILLPSYANAASLHLLLLRDISIYGEKLGFDSKTLQAYHNEQVKFTTDYTAHCIKTYNLNLNAQKSKGWVAFNQYRRDMTLTVLDLIALFPSYDTHRYPADEKNVKKLSNTELTREIYTALTESSPSKTVEAMEESLTRGPHLFTWPKRLDFWTFNYNMYPDTRYLSANRIGFSYTNSSEIEDSGIYGSPTFGTVLTHQIPLNSNVYRTSITDTTAVPNQVTKMDFYKIDGTNASYNSNITPVPANLRTTFFGFSSDANRPPNQPTVQDYNNILSYIKTDIIGGHQARVSFAWTHKGVNPNNQILTDNVTQVPAVKSSLLNAPARVIKGPGHTGGDLVALLNNGTQAGTMQIQCKTGSFTETSRRYGIRMRYAANNAFTVSLSYTLQGGNPIGITFGTERTFSRTNNIIPTDLKYEEFKYKEYNQIITMNSPQNTIVTIDIRQLNPSSNDQLIIDRIEFIPITQSVLDYTEEQNLETAQAVVDNLFTN

SEQ ID NO: 416 - protein, 679 aa, Bacillus thuringiensis S3161-3
MNSYQNTNEYEILDASPSYSNMTNSYPRYPLANNRQGSMKNTNYKDWLAMCEGNAEGLFLTDEQMVSIVGAAISKLLGFVPVVGDILSSLADTYWPKIAGQEADTRVWAGLIRHTANLIDNRDVDRVIGQATANVMSLYAALGVYNRFLEQWKSPVKPYAGLADEIRAQMSTLHLLFTTKIISDFPIQGYESILLPSYANAASLHLLLLRDISIYGEKLGFDSKTLQAYHNEQVKFTTDYTAHCIKTYNLNLNAQKSKGWVAFNQYRRDMTLTVLDLIALFPSYDTHRYPADEKNVKKLSNTELTREIYTALTESSPSKTVEAMEESLTRGPHLFTWPKRLDFWTFNYNMYPDTRYLSANRIGFSYTNSSEIEDSGIYGSPTFGTVLTHQIPLNSNVYRTSITDTTAVPNQVTKMDFYKIDGTNASYNSNITPVPANLRTTFFGFSSDANRPPNQPTVQDYNNILSYIKTDIIGGHQARVSFAWTHKGVNPNNQILTDNVTQVPAVKSSLLNAPARVIKGPGHTGGDLVALLNNGTQAGTMQIQCKTGSFTETSRRYGIRMRYAANNAFTVSLSYTLQGGNPIGITFGTERTFSRTNNIIPTDLKYEEFKYKEYNQIITMNSPQNTIVTINIRQLNPSSNDQLIIDRIEFIPITQSVLDYTEEQNLETAQAVVDNLFTN

SEQ ID NO: 417 - protein, 309 aa, Bacillus thuringiensis F14-1
MIFLAILDLKSLVLNAINYWGPKNNNGIQGGDFGYPISEKQIDTSIITSTHPRLIPHDLTIPQNLETIFTTTQVLTNNTDLQQSQTVSFAKKTTTTTSTSTTNGWTEGGKISDTLEEKVSVSIPFIGEGGGKNSTTIEANFAHNSSTTTFQQASTDIEWNISQPVLVPPRKQVVATLVIMGGNFTIPMDLMTTIDSTEHYSGYPILTWISSPDNSYNGPFMSWYFANWPNLPSGFGPLNSDNTVTYTGSVVSQVSAGVYATVRFDQYDIHNLRTIEKTWYARHATLHNGKKISINNVTEMAPTSPIKTN

SEQ ID NO: 418 - protein, 309 aa, EG2934
MAILDLKSLVLNAINYWGPKNNNGIQGGDFGYPISEKQIDTSIITFTHPRLIPYDLTIPQNLETIFTTTQVLTNNTDLQQSQTVSFAKKTTTTTSTSTTNGWTEGGKISDTLEEKVSVSIPFIGEGGGKNSTTIEANFAHNSSTTTFQQASTDIEWNISQPVLVPPSKQVVATLVIMGGNFTIPMDLMTTIDSTEHYSHYSGYPILTWISSPDNSYSGPFMSWYFANWPNLPSGFGPLNSDNTVTYTGSVVSQVSAGVYATVRFDQYDIHNLRTIEKTWYARHATLHNGKKISINNVTEMAPTSPIKTN

SEQ ID NO: 419 - protein, 695 aa, Bacillus thuringiensis Y41
MNFYQNTNEYEILDASQNNSTMSNRYPRYPLANNPQMPMRNTNYKDWLNMCEGNPAPLSSPSQLLKVAGNIVPRILGTLPTFFPGIGPFVPFLTFFTGLLWPSGSSGNDIWEKVMKEVADLIDQRLEENILRQATANLAGLKELLQSYNSAFATWEAGNATPGLVKGYMESLHRTFVQDIIGSFTIPNYENILLPTYAIAANFHLMLLRDIEIYGGEKTPEGKDGLNFNPKDLNFYNCELKKYKELYTNHCLNTYDKGLASEKEKGWVPFHRYRREMTLAVLDIIASFPLYDARLYPAKNNKEMSVKSELTREIYSDVINSDRFGVVPPYNYAQNEERYTRPPHLFTWLRGLDFVTNRLTSGSYSYRWYVLTGCQNKYSYTKGNGTIPGPFRGYPVESGGSASNITIEEGSYIYNLLPKSFEYISPWYFTTNIAMITFLLTNNKNDLPAKFYGSLVNQPNLPIVQTDFDFVTNKELTGPPTYNNYSHILSHMLLGYDWNQTGGIGTHGYSFAFTHSSVDPYNTIAPDKITQIPAVKAFEISDSGPGYVVAGRGDTGGDIVWLKNSARLKIRLTSATPNKNYLVRVRCMARISGNILVERWSLSSTKNDTFGVQGTLKYEYVNTLVTTFDQPGVELIIKNLTGNDMYFDKVDFIPIDIPIDKCTKCQFVGGVCTCSCPTLQSLDTEKEIVNSLFVE

SEQ ID NO: 420 - protein, 703 aa, Bacillus thuringiensis BM59-2
MNSYQNKNEYEILDASQNNSNMSNRYPRYPLANDPQASMQNTNYKDWLATCNGTPAPLYNSSQLLKISGNVVSRALGMLPIPGIAPLLSFLSTLLWPSGSSGNTIWESLMKEAADLIDQKLEENILRQATANLAGLQGLLGSYNSAFASWEAGGNATPDLVKGYMESLHRTFVQDIIGSFTIPGYEKILLPTYAITANFHLMLLRDIEIYGGKKTPEGKDGLNFDPKDLNFYNCELKKYKELYTNHCLNTYNKGLASEKEKGWVPFHRYRREMTLAVLDIIALFPLYDARLYPAKNNKEMPVKSELTREIYSDVINSDRFGVVPPYNYAQNEERYTRPPHLFTWLRGLDFVTNVLTSGTWVYRWSVLTGLSKEIFLYKREWYYNWSFSGLSCRVWWKNFQHYYCRRFLYLELVAKKLSIYFPLVFYDKYRTDYFLTNKNNSSTEKVYGYVAGNANLPTVQTDFDFLTNKEVTGPPTYNNYNHILSYLLLGYDWNQTGGIGTHGYSFAFTHSSVDPYNTIAPDKITQIPAVKAFEISDAGPSQVIAGPGHTGGDVVRLYLSGRLKIRLTPASTNKNYLVRVRYASPVSGTLRVERWSPSSVTNRDFTRLATGGFNSFGYVDTLVTTCNQSGVEIIIQNLGASDVIIDKVEFIPYDIPIDKCTKCEFEGNVCTCRCEGVQSLEKEKEIVNSLFVKENKVCTEVGG

SEQ ID NO: 421 - protein, 669 aa, Bacillus thuringiensis Y41
  SITE 522: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
MNSYQNKNEYEILDASQNNSTMSNHYPRYPLAKDPLASMQNTNYKDWLNLCDTPNMENPEFQSVGRSALSILINLSSKILSLLGIPFAAQIGQLWSYTLNLLWPVANNATQWDIFMRTIEDLINVRIETSVRNRALAELEGLGNILEDYKVALRRWDLNPTNLDRQSEVVSQFEIVHAFFRVQMPVFAIRDFEVPLLPVYASAANLHLLLLRDVVINGDRWGLSAARINDYHDLQLRLTSTYTDHCVNWYNTGLNRLIGTNARQWVTYNQFRREMTISVLDIISLFSNYDARRYPTKTQSELTRMIYTDPIGAVGTIGLNPGWLDNAPSFSVIENSVVQSPRTFLFLERVGIFTGVLHGWSSQSQFWSAHRLFLSNLSSIWESIIYGNPQNNIGYEEVDFTNFDVFSINSRATSIMSPFGGGELFGVPRVTFDLSNRTNNSLAQRTYNRPFTFGGQDIVSRLPGETTEIPNSSNFSHRLAYISSFRVGIAGSVLSYGWTHHSVDRHMRLNPNMITQIPAVKXVSGHIVSGPGHTGGDILRVHSGSQGTIIIQSNSAQRYRLRLRYSSTLPGDLILNHRGTDGSQQFIEFTLPATSGQLRFADFTYADGRTVFQTPNSHVFYTVHVQTRSNGIFFIDKIDYIPENTPPLECGGERNLEKEKKAVNDLFTN

SEQ ID NO: 422 - protein, 668 aa, Bacillus thuringiensis MC28
MNSYQNKNEYEILDASQNNSNMSTHYPRYPLAKDPQASMQNTNYKDWLNLCDTPNMENPEFQSVGRSALSILINLSSRILSLLGIPFAAQIGQLWSYTLNLLWPVANNATQWEIFMRTIEDLINVHIETSVRNRALAELAGLGNILEDYKVVLQRWNLNPTNPTLQRDVVRQFEIVHAFFRFQMPVFAVAGFEVPLLPVYASAANLHLLLLRDVVINGARWGLESDVINDYHDLQLRLTSTYVDHCVTWYNTGLNRLIGTNARQWVTYNQFRREMTISVLDIISLFSNYDVRRYPTKIQNELTRMIYTDPVGTEGNQFIPGWLDNAPSFSVIENSVVRSPGAFTFLERVGIFTGFLHGWSSRSEFWSAHRLFSRPVLGGIWESVIFGNPQNNIGYQEVDFTNFDVFSINSRATSHMFPNGSARLFGVPQVTFNLSNINNNSPAQRIYNRQFTFGGQDIVSRLPGETTEIPNSSNFSHRLAHISSFPVGNNGSVLSYGWTHHSVNRHNRLNPDMITQIPAVKGIGGQIVSGPGHTGGDILRFNRLNQGTIVVQSNSAQRYRIRLRYSSSLPGDLILNHIGSDGSQQFIEFTLPATSGQLRFADFTYADGRTVFQTPNSHVFYTVHVQTRSDATVFIDKIDYIPENTPTLERGGERYLEKEKKVVNDLFT

SEQ ID NO: 423 - protein, 673 aa, Bacillus thuringiensis MC28
MSMKSLIQRIYLVLLTEILTILDTLLQIIRINHYKNWINMCQKNQQYGENLETFASADTIAGVSAGVIVVGTMLGAFAAPITAGLIISFGTLLPIFWKPGEDPKTVWQAFLKIGNRPFSSPVDQALIDLLSNKARSLESQFNDFQRYFDIWNNNKTPGNAGEVLRRFSSLDADIIRELEQLKGNYYITVLPGYAQVANWHLNLLRIAAFYYDQWASSSNLSIQSIYPEDYINDLQTCLTNCAIESGNKISSKYYKCVLKCRINEYINYCSKTYQEGLNILKNSSGLKWNEYNTYRREMTLNVLDLIAVFPNYDPDKYLISTKSQLTREIYTDALIDAFANAHFNINDIENSLTRPPGLVTWINRLDFYTGMFTKSVPGLTANGINYSFTNGNSNDSPIYGYRLSDDSSTPIQIPRNQYVYNMLITYLRDSPSVIQKIEFNLNNQQTRTYDTGLTLAPTYQSTINLSLPGKDRSFPPKFNNYTHFLSYVKTAPGDERPSSSRARNVCFGWMHFSVNDYDVLAGGYNTISNKIITQIPAVKARHLPLPSFVMPGPGHTGGNLVVLSTQIEFQCIVLNPVSYKIRMRYVAYSPNRSINLTVSIRSEIGNYQNIVPNISSTVQSPEDTKNPKYEHFQYLDISIPLELFGITNITITRSDSISNNTLIIDKIEFTPDV

SEQ ID NO: 424 - protein, 699 aa, Bacillus thuringiensis S2160-1
MNHNNNNNKYEIIDSHASPYPSNKNSNHSRYPYTNNTNYKDWLNICQQNQQYDEGFETFESADTIAAVSAGIIVAGTMLSAFTSPLGPALIISFGTLLPIFWKPGEDPKTVWKAFVKIGYRPFGLPVDEAIVNLLYNKVDALKTQFEDYQRYFDIWKANPTSQNADAVKNKFLTLDTLVIGTLQELKKDYAIILLPGYTQIANWHLNLLRQAADNYDKWAPSSNLSIQSIYPQDYISDLNTCLTNCSTESNNKVSSKYYKCILKCRTAEYINHCSEKYQDGLNQLKNSSNINWDIYNAYRREMTFTVLDHIAIFPNYDPEKYPTGTHSELTREIYTDAVMRRYETGSPIPIAQREQELTRTPHLFSRLNKFTLFTAKNILPGLHAVQNHFSYTNDSTVRLSPIYKPENLSEPNTDNPPPFDISNTAVRSIAVKRRYEYYHITAIDFDTIDGNPRRYNSGYTPENLGIDYFIFTEFPAGKIPPYGLGTKYTHILSYIKISPRGNLSLPAERELSFAWTHTSVNFNNTISNTITTQIPAVKAKSLDPSSSVISGPGHTGGDLVSLRSSMQIMCYVPTAARYQIRMRCVAYSPNRSINLTLNIAGVTNYSLRALGIGSIKNIINPKYDDFQYIYFQTEDPQQVATVNLSSNFTMFLNSSDFADNTILIDKFEFIPITNTLEENLETQKLEKIQQTVNTLFTN

SEQ ID NO: 425 - protein, 362 aa, YBacillus thuringiensis 1518
MNKKSITHEEFIRQLKEYNLDNNLNYHDPAVLKKINELLPADQQYDLISPTQDWYQFKTLYPISKNGVIISSNLDDSSNVLVPELSENPYDPIPQSGKSTIQTAVRSPEALYIILTTNNSLSFGGGTNTMIATRIALLSVTRPELYQAITKVNYVYKSGQTAPRNAPVAYIELSPNNSYVQTLLNDSHMKRTSSYELVGSSIARRGIETKWSKSHTSGVSDTDSWSLAVSAGIDIEWDVGIPLTASAKEKLSLSITGTYGQSTTVSSQDTITQEYTFAKPGKDYKYDDYAYAVYQLKSNYQFIAGDAFNNLINSLSFGNQFSVHGDASYQYSTDTIFSTQTPDPTPTNEKSLIQVNFNPRFS

SEQ ID NO: 426 - protein, 663 aa, Bacillus thuringiensis Ywc2-8
MNSYQNKNEYEISDASRNNSNMSTRYPRYPLANNPQMPMRNTNYKEWLAMCADNKDNEQVPISPLDQEWRTVLPILFSAAASLTGLISLPTFGAISAGAAIAAALTSILFPSQGPDVFNELMGATENLLKREIETYVRGRAASELLALEDQRAYFKSAFDYWRLHPTDGNAIATVAARFHTVNGAFVTAMRLFRPAGYEALLLPVYAQAARLHLLHLRDGVLFANEWGLAKPDPGDLHDQEFNAKAAEYADYCELTYNTELNRIKTTSGKTWFDYNQYRRLMTFAVLDVVAKFSILNPRIYSLALQGEILTRKIYTDPVNFSPGSSIADDENRYTVPPSHVRQLVNSRLFTNVASVQNAGFIGNQNRYKNIGVSDLVDGPIIGQSVFEKVDADIPTNVSVFEVGVNGIQNDYPRNIGLKKTPSNAFTNNYAGSTNNLGPFTTVSLPPKDDKPLDHTNFSHRLSDIILPGNKGSSFAWTHVDVDPTGNYLSTTKINLIPATKASKLPLSFQLRKGPGFIGGDLVRLGNGVGISYKFNFQSSDSSANFRIRIRYAGAGSGASGGGQVYFKLGNYQSPDTSWGHTGFDSNNVKYNQFKVLELLGTAGNITANDLEIIVWTRDPGASDFYLDRLELIPMTGISTEYNEPQKLETAKKAVNDLFTNNL

SEQ ID NO: 427 - protein, 663 aa, Bacillus thuringiensis G7-1
MNSYQNKNEYEILDASRNNSNMSTRYPRYPLANNPQMPMRNTNYKEWLAMCADNKNNEQVPISPLDQEWRTVLPILFSAAASLTGLISLPTFGAISAGAAIAAALTSILFPSQGPDVFNELMGATENLLKREIETYVRGRAASELLALEDQRAYFKSAFDYWRLHPTDGNAIATVAARFHTVNGAFVTAMRLFRPAGYEALLLPVYAQAARLHLLHLRDGVLFANEWGLAKPDPGDLHDQEFNAKAAEYADYCELTYNTELNRIKTTSGKTWFDYNQYRRLMTFAVLDVVAKFSILNPRIYSLALQGEILTRKIYTDPVNFSPGSSIADDENRYTVPPSHVRQLVNSRLFTNVASVQNAGFIGNQNRYKNIGVSDLVDGPIIGQSVFEKVDADIPTNVSVFEVGVNGIQNDYPRNIGLKKTPSNAFTNNYAGSTNNLGPFTTVSLPPKDDKPLDHTNFSHRLSDIILPGNKGSSFAWTHVDVDPTGNYLSTTKINLIPATKASKLPLSFQLRKGPGFIGGDLVRLGNGVGISYKFNFQSSDSSANFRIRIRYAGAGSGASGGGQVYFKLGNYQSPDTSWGHTGFDSNNVKYNQFKVLELLGTAGNITANDLEIIVWTRDPGASDFYLDRLELIPMTGISTEYNEPQKLETAKKAVNDLFTNNL

SEQ ID NO: 428 - protein, 665 aa, Bacillus thuringiensis kim LBIT-980
MNSYQKKNDYEILNASPSYFNTLDSYPRYPLANDPQASMQTRNYKDWQNECEGITPSGFGAFSFIISIIIQFQSFLSEPSLSGGLGIGLDIADSLIADDVSQLSAREVRDLIQSGLTDLAISIASGSFNDIVEKYRDYLEVFKRWESGGRTDDDTRETIGRLIMDAERAAAELNQFSHGDYKIPLLPTYAQAANLHLKILRDILIHGEDLQIISTADRQFYRDKLFGGLKNYTNYCVDQYNAGLNQIKEAGTSAANWLRFHRFRREMTLSVLDLIALFPTYDIDSYDLPVNVELSRIIYTDPVGWTVEGMSTIYPWYSPYNRLAFNQLEAETIRGPYLSTWLDYIDIYSSQYSSLKVWSGNANTMKTIGGETRRQDGSAVGTPQRITVGNTDIFKVELTAGVHHFLIDYTNPNPLRSYGIINSKFFMTNGSTPTYTGSVGSMHTQTGKVAALPGVESEVPTANDYTHRLSDVINLTGGLPQHGSNSVRSSLVAHGWTHKSLKRENIIEANQISQIPAVKSYSMSGGLTVRHVSDHTGGDVVYFAQVGRVKILCKFTSPGYYKMRIRYASDYSATMTVNGIPVSLSSTTQVRSNLPYEAFQYAQVGPNHVFAVLTPKTLEFDIYGGVNGFMIDKIEFIPSNITTLEYEEERDLEKTKNAVNDLFIN

SEQ ID NO: 429 - protein, 1385 aa, Bacillus thuringiensis darmstadiensis PS17
MAILNELYPSVPYNVLAYTPPSFLPDAGTQATPADLTAYEQLLKNLEKGINAGTYSKAIADVLKGIFIDDTINYQTYVNIGLSLITLAVPEIGIFTPFIGLFFAALNKHDAPPPPNAKDIFEAMKPAIQEMIDRTLTADEQTFLNGEISGLQNLAARYQSTMDDIQSHGGFNKVDSGLIKKFTDEVLSLNSFYTDRLPVFITDNTADRTLLGLPYYAILASMHLMLLRDIITKGPTWDSKINFTPDAIDSFKTDIKNNIKLYSKTIYDVFQKGLASYGTPSDLESFAKKQKYIEIMTTHCLDFARLFPTFDPDLYPTGSGDISLQKTRRILSPFIPIRTADGLTLNNTSIDTSNWPNYENGNGAFPNPKERILKQFKLYPSWRAGQYGGLLQPYLWAIEVQDSVETRLYGQLPAVDPQAGPNYVSIDSSNPIIQINMDTWKTPPQGASGWNTNLMRGSVSGLSFLQRDGTRLSAGMGGGFADTIYSLPATHYLSYLYGTPYQTSDNYSGHVGALVGVSTPQEATLPNIIGQPDEQGNVSTMGFPFEKASYGGTVVKEWLNGANAMKLSPGQSIGIPITNVTSGEYQIRCRYASNDNTNVFFNVDTGGANPIFQQINFASTVDNNTGVQGANGVYVVKSIATTDNSFTEIPAKTINVHLTNQGSSDVFLDRIEFIPFSLPLIYHGSYNTSSGADDVLWSSSNMNYYDIIVNGQANSSSIASSMHLLNKGKVIKTIDIPGHSETFFATFPVPEGFNEVRILAGLPEVSGNITVQSNNPPQPSNNGGGDGGGNGGGDGGQYNFSLSGSDHTTIYHGKLETGIHVQGNYTYTGTPVLILNAYRNNTVVSSIPVYSPFDITIQTEADSLELELQPRYGFATVNGTATVKSPNVNYDRSFKLPIDLQNITTQVNALFASGTQNMLAHNVSDHDIEEVVLKVDALSDEVFGDEKKALRKLVNQAKRLSRARNLLIGGSFENWDAWYKGRNVVTVSDHELFKSDHVLLPPPGLSPSYIFQKVEESKLKPNTRYIVSGFIAHGKDLEIVVSRYGQEVQKVVQVPYGEAFPLTSNGPVCCPPRSTSNGTLGDPHFFSYSIDVGALDLQANPGIEFGLRIVNPTGMARVSNLEIREDRPLAANEIRQVQRVARNWRTEYEKERAEVTSLIQPVINRINGLYENGNWNGSIRSDISYQNIDAIVLPTLPKLRHWFMSDRFSEQGDIMAKFQGALNRAYAQLEQSTLLHNGHFTKDAANWTIEGDAHQITLEDGRRVLRLPDWSSSVSQMIEIENFNPDKEYNLVFHGQGEGTVTLEHGEETKYIETHTHHFANFTTSQRQGLTFESNKVTVTISSEDGEFLVDNIALVEAPLPTDDQNSEGNTASSTNSDTSMNNNQ

SEQ ID NO: 430 - protein, 1289 aa, Bacillus thuringiensis darmstadiensis PS17
MAILNELYPSVPYNVLAYTPPSFLPDAGTQATPADLTAYEQLLKNLEKGINAGTYSKAIADVLKGIFIDDTINYQTYVNIGLSLITLAVPEIGIFTPFIGLFFAALNKHDAPPPPNAKDIFEAMKPAIQEMIDRTLTADEQTFLNGEISGLQNLAARYQSTMDDIQSHGGFNKVDSGLIKKFTDEVLSLNSFYTDRLPVFITDNTADRTLLGLPYYAILASMHLMLLRDIITKGPTWDSKINFTPDAIDSFKTDIKNNIKLYSKTIYDVFQKGLASYGTPSDLESFAKKQKYIEIMTTHCLDFARLFPTFDPDLYPTGSGDISLQKTRRILSPFIPIRTADGLTLNNTSIDTSNWPNYENGNGAFPNPKERILKQFKLYPSWRAAQYGGLLQPYLWAIEVQDSVETRLYGQLPAVDPQAGPNYVSIDSSNPIIQINMDTWKTPPQGASGWNTNLMRGSVSGLSFLQRDGTRLSAGMGGGFADTIYSLPATHYLSYLYGTPYQTSDNYSGHVGALVGVSTPQEATLPNIIGQPDEQGNVSTMGFPFEKASYGGTVVKEWLNGANAMKLSPGQSIGIPITNVTSGEYQIRCRYASNDNTNVFFNVDTGGANPIFQQINFASTVDNNTGVQGANGVYVVKSIATTDNSFTVKIPAKTINVHLTNQGSSDVFLDRIEFVPILESNTVTIFNNSYTTGSANLIPAIAPLWSTSSDKALTGSMSITGRTTPNSDDALLRFFKTNYDTQTIPIPGSGKDFTNTLEIQDIVSIDIFVGSGLHGSDGSIKLDFTNNNSGSGGSPKSFTEQNDLENITTQVNALFTSNTQDALATDVSDHDIEEVVLKVDALSDEVFGKEKKTLRKFVNQAKRLSKARNLLVGGNFDNLDAWYRGRNVVNVSNHELLKSDHVLLPPPGLSPSYIFQKVEESKLKRNTRYTVSGFIAHATDLEIVVSRYGQEIKKVVQVPYGEAFPLTSSGPVCCIPHSTSNGTLGNPHFFSYSIDVGALDVDTNPGIEFGLRIVNPTGMARVSNLEIREDRPLAANEIRQVQRVARNWRTEYEKERAEVTSLIQPVINRINGLYDNGNWNGSIRSDISYQNIDAIVLPTLPKLRHWFMSDRFSEQGDIMAKFQGALNRAYAQLEQNTLLHNGHFTKDAANWTVEGDAHQVVLEDGKRVLRLPDWSSSVSQTIEIENFDPDKEYQLVFHGQGEGTVTLEHGEETKYIETHTHHFANFTTSQRQGLTFESNKVTVTISSEDGEFLVDNIALVEAPLPTDDQNSEGNTASSTNSDTSMNNNQ

SEQ ID NO: 431 - protein, 931 aa, Bacillus thuringiensis L366
MAILNELYPSVPYNVLAYTPPSFLPDAGTQATPADLTAYEQLLKNLEKGINAGTYSKAIADVLKGIFIDDTINYQTYVNIGLSLITLAVPEIGIFTPFIGLFFAALNKHDAPPPPNAKDIFEAMKPAIQEMIDRTLTADEQTFLNGEISGLQNLAARYQSTMDDIQSHGGFNKVDSGLIKKFTDEVLSLNSFYTDRLPVFITDNTADRTLLGLPYYAILASMHLMLLRDIITKGPTWDSKINFTPDAIDSFKTDIKNNIKLYSKTIYDVFQKGLASYGTPSDLESFAKKQKYIEIMTTHCLDFARLFPTFDPDLYPTGSGDISLQKTRRILSPFIPIRTADGLTLNNTSIDTSNWPNYENGNGAFPNPKERISKQFKLYPSWRAGQYGGLLQPYLWAIEVQDSVETRLYGQLPAVDPQAGPNYVSIDSSNPIIQINMDTWKTPPQGASGWNTNLMRGSVSGLSFLQRDGTRLSAGMGGGFADTIYSLPATHYLSYLYGTPYQTSDNYSGHVGALVGVSTPQEATLPNIIGQPDEQGNVSTMGFPFEKASYGGTVVKEWLNGANAMKLSPGQSIGIPITNVTKQNYQVRCRYASNSDNPVFFNVDTGGANPIFQQINFESTVDSNMGVKGENGVYVVKSIATTDNSFTVKIPAKTINVHLTNQGSSDIFLDRIEFIPFKLTLSPTPITLDPMKTITASVLSATRASDGITTINDPVDGTLLSLPMGTSIDFSILNPTQTGTYQVSILYKSSSGGFTITKVTNDQNGQMVDYASTSELQYSNPIYVLSSNTGNTVLTIGPGGYSGPDLLIKEIRFTPATPNSSNKIDTDFQLVDGQGTVTIWKSDKIAYTLADIDIQISFNQTAWQSPNITPYLNDDPVGGIATFYNTTGESQHFTKDSLLFQRGFNNIRVNNGFGGATISGHMKANVIDNPS

SEQ ID NO: 432 - protein, 1245 aa, Bacillus thuringiensis PS86Q3
MATINELYPVPYNVLAHPIKEVDDPYSWSNLLKGIQEGWEEWGKTGQKKLFEDHLTIAWNLYKTGKLDYFALTKASISLIGFIPGAEAAVPFINMFVDFVWPKLFGANTEGKDQQLFNAIMDAVNKMVDNKFLSYNLSTLNKTIEGLQGNLGLFQNAIQVAICQGSTPERVNFDQNCTPCNPNQPCKDDLDRVASRFDTANSQFTQHLPEFKNPWSDENSTQEFKRTSVELTLPMYTTVATLHLLLYEGYIEFMTKWNFHNEQYLNNLKVELQQLIHSYSETVRTSFLQFLPTLNNRSKSSVNAYNRYVRNMTVNCLDIAATWPTFDTHNYHQGGKLDLTRIILSDTAGPIEEYTTGDKTSGPEHSNITPNNILDTPSPTYQHSFVSVDSIVYSRKELQQLDIATYSTNNSNNCHPYGLRLSYTDGSRYDYGDNQPDFTTSNNNYCHNSYTAPITLVNARHLYNAKGSLQNVESLVVSTVNGGSGSCICDAWINYLRPPQTSKNESRPDQKINVLYPITETVNKGTGGNLGVISAYVPMELVPENVIGDVNADTKLPLTQLKGFPFEKYGSEYNNRGISLVREWINGNNAVKLSNSQSVGIQITNQTKQKYEIRCRYASKGDNNVYFNVDLSENPFRNSISFGSTESSVVGVQGENGKYILKSITTVEIPAGSFYVHITNQGSSDLFLDRIEFVPKIQFQFCDNNNLHCDCNNPVDTDCTFCCVCTSLTDCDCNNPRGLDCTLCCQVENQLPSFVTLTDLQNITTQVNALVASSEHDTLATDVSDYEIEEVVLKVDALSGEVFGKEKKALRKLVNHTKRLSKARNLLIGGNFDNLDAWYRGRNVVNVSDHELFKSDHVLLPPPTLYSSYMFQKVEESKLKANTRYTVSGFIAHAEDLEIVVSRYGQEVKKVVQVPYGEAFPLTSRGAICCPPRSTSNGKPADPHFFSYSIDVGTLDVEANPGIELGLRIVERTGMARVSNLEIREDRPLKKNELRNVQRAARNWRTAYDQERAEVTALIQPVLNQINALYENEDWNGAIRSGVSYHDLEAIVLPTLPKLNHWFMSDMLGEQGSILAQFQEALDRAYTQLEESTILHNGHFTTDAANWTIEGDAHHAILEDGRRVLRLPDWSSSVSQTIEIENFDPDKEYQLVFHAQGEGTVSLQHGEEGEYVETHPHKSANFTTSHRQGVTFETNKVTVEITSEDGEFLVDHIALVEAPLPTDDQSSDGNTTSNTNSNTSMNNNQ

SEQ ID NO: 433 - protein, 1245 aa, YBacillus thuringiensis 1518
MATINELYPVPYNVLAHPIKEVDDPYSWSNLLKGIQEGWEEWGKTGQKKLFEDHLTIAWNLYKTGKLDYFALTKASISLIGFIPGAEAAVPFINMFVDFVWPKLFGANTEGKDQQLFNAIMDAVNKMVDNKFLSYNLSTLNKTIEGLQGNLGLFQNAIQVAICQGSTPERVIFDQNCTPCNPNQPCKDDLDRVASRFDTANSQFTQHLPEFKNPWSDENSTQEFKRTSVELTLPMYTTVATLHLLLYKGYIEFMTKWNFHNEQYLNNLKVELQQLIHSYSETVRTSFLQFLPTLNNRSKSSVNAYNRYVRNMTVNCLDIAATWPTFDTHNYHQGGKLDLTRIILSDTAGPIEEYTTGDKTSGPEHSNITPNNILDTPSPTYQHSFVSVDSIVYSRKELQQLDIATYSTNNSNNCHPYGLRLSYTDGSRYDYGDNQPDFTTSNNNYCHNSYTAPITLVNARHLYNAKGSLQNVESLVVSTVNGGSGSCICDAWINYLRPPQTSKNESRPDQKINVLYPITETVNKGTGGNLGVISAYVPMELVPENVIGDVNADTKLPLTQLKGFPFEKYGSEYNNRGISLVREWINGNNAVKLSNSQSVGIQITNQTKQKYEIRCRYASKGDNNVYFNVDLSENPFRNSISFGSTESSVVGVQGENGKYILKSITTVEIPAGSFYVHITNQGSSDLFLDRIEFVPKIQFQFCDNNNLHCDCNNPVDTDCTFCCVCTSLTDCDCNNPRGLDCTLCCQVENQLPSFVTLTDLQNITTQVNALVASSEHDTLATDVSDYEIEEVVLKVDALSGEVFGKEKKALRKLVNHTKRLSKARNLLIGGNFDNLDAWYRGRNVVNVSDHELFKSDHVLLPPPTLYSSYMFQKVEESKLKANTRYTVSGFIAHAEDLEIVVSRYGQEVKKVVQVPYGEAFPLTSRGAICCPPRSTCNGKPADPHFFSYSIDVGTLDVEANPGIELGLRIVERTGMARVSNLEIREDRPLKKNELRNVQRAARNWRTAYDQERAEVTALIQPVLNQINALYENEDWNRAIRSGVSYHDLEAIVLPTLPKLNHWFMSDMLGEQGSILAQFQEALDRAYTQLEESTILHNGHFTTDAANWTIEGDAHHAILEDGRRVLRLPDWSSSVSQTIEIENFDPDKEYQLVFHAQGEGTVSLQHGEEGEYVETHPHKSANFTTSHRQGVTFETNKVTVEITSEDGEFLVDHIALVEAPLPTDDQSSDGNTTSNTNSNTSMNNNQ

SEQ ID NO: 434 - protein, 1245 aa, Bacillus thuringiensis zjfc85
MATINELYPVPYNVLAHPIKEVDDPYSWSNLLKGIQEGWEEWGKTGQKKLFEDHLTIAWNLYKTGKLDYFALTKASISLIGFIPGAEAAVPFINMFVDFVWPKLFGANTEGKDQQLFNAIMDAVNKMVDNKFLRYNLSTLNKTIEGLQGNLGLFQNPIQVAICQGSTPERVIFDQNCTPCNPNQPCKDDLDRVASRFDTANSQFTQHLPEFKNPWSDENSTQEFKRTSVELTLPLYTTVATLHLLLYKGYIEFMTKWNFHNAQYLNNLKVELQQLIHSYSETVRTSFLQFLPTLNNRSKSSVNAYNGYVRNMTVNCLDIAATWPTFDTHNYHQGRKLDLTRIILSDTAGPIKEYTTGDKTSGPQHSNITPNNILDTPSPTYQHSFVSVDSIVYSRKELQQLDIATYSTNNSNNCHPYGLRLSYTDGSRYDYGDNQPDFTTSNNNYCHNSYTAPITLVNARHLYNAKGSLQNVESLVVSTVNGGSGSCICDAWINYLRPPQTSKNESRPDQKINVLYPITETVNKGTGGNLGVISAYVPMELVPENVIGDVNADTKLPLTQLKGFPFEKYGSEYNNRGISLVREWINGNNAVKLSNSQSVGIQITNQTKQKYEIRCRYASKGDNNVYFNVDLSENPFRNSISFGSTESSVVGVQGENGKYILKSITTVEIPAGSFYVHITNQGSSDLFLDRIEFVPKIQFQFCDNNNLHCDCNNPVDTDCTFCCVCTSLTDCDCNNPRGLDCTLCCQVENQLPSFVTLTDLQNITTQVNALVASSEHDTLATDVSDYEIEEVVLKVDALSGEVFGKEKKALRKLVNHTKRLSKARNLLIGGNFDNLDAWYRGRNVVNVSDHELFKSDHVLLPPPTLYSSYMFQKVEESKLKANTRYTVSGFIAHAEDLEIVVSRYGQEVKKVVQVPYGEAFPLTSRGAICCPPRSTCNGKPADPHFFSYSIDVGTLDVEANPGIELGLRIVERTGMARVSNLEIREDRPLKKNELRNVQRAARNWRTAYDQERAEVTALIQPVLNQINALYENEDWNRAIRSGVSYHDLEAIVLPTLPKLNHWFMSDMLGEQGSILAQFQEALDRAYTQLEESTILHNGHFTTDAANWTIEGDAHHAILEDGRRVLRLPDWSSSVSQTIEIENFDPDKEYQLVFHAQGEGTVSLQHGEEGEYVETHPHKSANFTTSHRQGVTFETNKVTVEITSEDGEFLVDHIALVEAPLPTDDQSSDGNTTSNTNSNTSMNNNQ

SEQ ID NO: 435 - protein, 1327 aa, Bacillus thuringiensis T13001
MATLNNMFSVPYNVLALPIIPNSILTFEDNRKKIEEGIKEFEKTGRIKPLKDLIELIFKGYSDDESSYAALVQTMLVVIPLAFPELAPVLPIIGVVINFVFPGLKGSAKSTYTMITEMVDKAINQSFTAQITNILTNNITGIQNNIQSVYDAMSNAIGTNDTIHNFIRNNDTTPCSQNNQPACPCPPNNQCLQKVVDEYTKAIANIDLIIPQFHDPLTGVISDLATANMYILPLYAQTVNLKLILRQSFIEFMEKYKYDEKETVFQAFINADIPEQIKKLRQDIITYTKDIYMQFEAHAPYPTYNSKKQLNDYIRYTRIIQVYCLDLVAMWPTLDRVNYALPVQQNMTRIIFGDLIGPVETVPQVPRQNSDNFHFNLSDVYRNPLPNNDIFNYRYGGLQISKAQFMTYYKKFGAFSTHDEYYYVDGHRLSFNTSDKKTIEINAHQNSHDTIEKDVIDQLGGYVTRMNMVSQEIGSGSILGGNAIDRTALTTSTGDKDILAAGFNAINNGNYKTEGRGASHNQDVPNHKVQAIYPVQPNKYEYDDYGSEEKYGYLYTLIPMDVSFIPQLNAEDVITTIPAEQAVKINGQSVIDTVNTNSLLEFVNGANAIKLSPGETAQYTMINPVNRSYQVRVRVATEGETQLDIIAPVDSNTLNLSNTKTTANDQNGILGKQGNYIVFPQPNIDTVTGTSLPPTENIMNFPVGTFDFTIVNSGNSDTILDRIEFVPIVTSNKIQQDFTISPGTSQVIWTGNSANTIDITIIDNVDTSGLFVQIFQKGKQLHGELTLIDPAHIQRTFSEKFDQIVLYNPGYNSSISGTVSGSVSSIPKKFELSSDLQNITNQVNNLFASSEHDTLATDVSDYDIEEVILKVDALSDEVFGKEKKALRKLVNQAKRLSKARNLLLGGSFDNLDAWYRGRNVVTVSDHELFKSDHILLPLPTTLYPSYLFQKVEESKLKANTRYTVSGFIAHAEDLEIVVSRYGQEIKKVVQVPYGEAFPLTSSGPICCRPRSRVNGKPADPHFFSYSIDVGALDVEANPGIELGFRIVEPTGMARVSNLEIREDRPLTANEIRKVQRAARDWKQKYDQERAEVRALIQPVLNQINALYENEDWNGAIRSGVSYHDLEAIVLPTLPKLNHWFMSDMLGEQGSILAQFQEALNRAYTQLEGSTILHNGHFTTDAANWTIEGDAHQVVLEDGRRVLRLPDWSSSLSQTIEIENFDPDKEYQLVFHGQGEGTVTLEHGEEGEYVETHPHKFANFTTSQRQGITFESNKVTVTISSEDGEFLADNIAIVEVPMFNKNQMVNENRGVNINSNTNMNSSNNSNNQ

SEQ ID NO: 436 - protein, 1179 aa, Bacillus thuringiensis T13001
MVTVNEIYPSYYNVLASPYVFESNTDSIEKAVDDFRKGLAKGDVTKQVVNIIESIKDGKFNYQTVITSILSLASMVLPEIGFFMPIIGLFFSALSGGGPSIDIGSIFKAIQPAIQQMIDKSLTEDNIKDMDTQATVLQTQLKAYQTQLKAYTSITNPGTTDISDLHRVLDNTIEQLNSNLAFFQKEGYKDIGLPYYCLFATLYFTLLSDKIKNGVKWGYNSQAIPSFQTTFDTDLASHTQYVLNTYFENMPKSDDPARDARDDGDDGDAKFENKKAKYIRGMTLSCLDYVSLWPTFSPRDYSQEVDVEQTRTIVASPNISYFAHNIAPPPYHSPLSRIKIYNIVDPLYYGLPIIGAEKWDQSGGYETEGKLNGVQTPSVTFPQNDPVIQTLPCVAGPAESIIGVIGGYTFNLKSGNQLSLLPDHVLPMPCSLVGGLVGDEEDVKFPDNHKLNYMIDAKTSGYSVTVFENLVPENIIGQPVDTDNGNTVLQIKGFPAEKGRIGNPDQGELHYVYEPGNGAAAIDLKPYQILELPFYNYTNGDYHVRIRYASKSDIPAYFSVNTPNGSQARGPITLPNTETQASAVPGMSGKYAFNEGATVTIPVVKDKDYCTVNIQNNSQEALFIDRIEFVPKTNLCDNLHCDCNNPVDTDCQMCCICASLTDCDCNNPHGFDCAICCSLGISHPSFVTLTDLQNITTQVNALFASETKNMLAKEVNDHDIEEVVLKVDALSDEVFGTEKKALRKLVNQAKRLSKARNLLVGGSFENWDAWYKGQKVIRLSDHELLKGDHVFLPSPTLYPSYIFQKVEESKLKPNTRYTVSGFIAHAIGLEIVVSRYGQEIKKVVQVPYGEAFPLTPIGRICCQSYSTSNGKPVDPHFFSYSIDVGALDVEANPGIEFGLRIVERTGMARVSNLEIREDRSLTANELRIVQRAARDWKTTYDQERAEVTALIQPVLNQINGLYENGDWNGVIRSGISYHDVESIVLPTLPKLRHWFISDMLSAQGNIIARFQEVLNFAHRQLEENTLLHNGHFTTDAANWTVEGDAHQRTLEDGRRVLRFPDWSSSVSQTIEIENFDPNKEYQLVFHGQGEGTVTLEHGEETKYIETHTHHFANFTTSQRQGLTFESNKVTVTISSEDGEFLVDNIALVEVPMFNKNQMVNENRGININSNTNMNSSNNQ

SEQ ID NO: 437 - protein, 869 aa, Bacillus thuringiensis T13001
MKNLEKGLTGQDATKAIANALQLIFIDDTVNYQSYVNFALSLITIAVPEIGILTPFIGLFFAALNKNSATPPSATDIFQAMQPAIQAMIDKSLETEELKHLNDAAAELRGALSAYQDEMDTIQGLGGFDKVDQATKDLFWGKLIDVDTFFRVKVPVFIQPNPQFPDLVLISAPYYTMFASMHLIFLRDIIYHGQTWNAKKFTQGVNGVSGSLDAYKIDLKKLIKTYSKNIHDIFNQGLQRYGDSFNDTVQFRKKQQYIEIMTTHCLDFARLFPTFDPDLYPIGSSGINLQKTRRLLSPILPIREFDVVSIDTSKWPDYNNGLLPDPNKRVLKKVTLYPYYGSRWDPNRNILWAVEIEDSFGTQLYGTIPPDSSSIDTGDKGGAHPIPIDPSNPVVDIYMYSFHTNGEATIQFTMKDGTQYKVGWVGSLQRYEIPGAHYLSYLYEVDYTKDDDPKYGYGRIGRLVGVSTPQEAMGENYIGIPDEDGNLSGMGFAWENGDIDNGIGSLQVVKETITGTNVVKLNYQQIVRLPIQNKTKLSYNVRIHYASKNEIKGFFHIYTGSDDLLKGEVTFPSTETDDVQKMVAVQGDNGKYALHVFETPVTLPVGQFTAYIQNNSTEDFYLDRIEFVPVTSDDNLPDITIPFHANLSIQPGESQTIWKSPGSRVGISTDFTTHVLSNFVGFAQYYKSGEPLDRSSMGDLSDHVQKSISTGFDEIRIMNAGEVGTASIVGTVSGSIDLSSNNNPGNNPNDTVTIDTSFDVSRGDTQIIWTAPQSKLGVSTKFQLDLGIYSTIELHYLKSGVIQQPIGVYSDDDQDNLIQDSVPTGFDQIEVYNSYDFYNHFDNAEGSLKGTISFASNSSRNTFVFLKNK

SEQ ID NO: 438 - protein, 303 aa, Bacillus thuringiensis jegathesan
MEITDIVLKIYDFIEWDYVTNQDGIPYTLFDKAIYEYELNDTVTIPETKVFKTTPIPIASALTITENRSSQTQLHTIKFSEKKMESVTNTTVHGFKIGGAIKVGAKGTVTANFLVSGGTAEANVELSLTGEYNYSSTTANVNQTEKTWEITENVSVASHTSLTSQLIIMQADIRVPMILNSNLIGKRYYDDYANMFFSYIFQSKTSGRTEMISPASRLANQSWPGKPIVFKSGGSNGSLNLSGFGYSDLYKGLYAFIRYTETPLDRYSSPGKTWDSNLIHLRDGQILNVYDNRGIVKPVRLVE

SEQ ID NO: 439 - protein, 303 aa, Bacillus thuringiensis israelensis
MEITDIVLKIYDFIEWDYVTNQDGIPYTLFDKAIYEYELNDTVTIPETKVFQTTPIPIASALTITENRSSQTQLHTIKFSEKKMESVTNTTVHGFKIGGAIKVGAKGTVTANFLVSGGTAEANVELSLTGEYNYSSTTANVNQTEKTWEITENVSVASHTSLTSQLIIMQADIRVPMILNSNLIGKRYYDDYANMFFSYIFQSKTSGRTEMISPASRLANQSWPGKPIVFKSGGSNGSLNLSGFGYSDLYKGLYAFIRYTETPLDRYSSPGKTWDSNLIHLRDGQILNVYDNRGIVKPVRLVE

SEQ ID NO: 440 - protein, 303 aa, Bacillus thuringiensis IBL 4222; identical to SEQ ID NO: 439

SEQ ID NO: 441 - protein, 319 aa, Bacillus thuringiensis malayensis
MTITNIELAIRDYTNWDGTREIPGYINRQVIDGPNIYDYVISDSVAVPKTVIFNVNPTPYTGPNIISENNTDVNQNKRIKFSEKVVETTTHTTTKGFKIGGGIKSTTKGTLKLKFPVGELGFEQTPELPPTGEYNSSSTTGNTCANEKLWEITDNITVPPHSRVTSTLIIMKTEVRVPMELTTNLRGTNSSGEGSFPTSNGLFSYTTSARGTVGGIFVSYYVRPASALYNTSWPDKPATFNSIGSNESLNLLGSGYSDVVPSLYVTIRQDQTPLSGYPGETKTWYSDKVILRDGRIVTLPSNADVNMSQTAKIPYCDRS

SEQ ID NO: 442 - protein, 319 aa, Bacillus thuringiensis israelensis
MTITNIELAIRDYTNWDGTREIPGYINRQVIDGPNIYDYVISDSVAVPKTVIFNVNPTPYTGPNIISENNTDVNQNKRIKFSEKVVETTTHTTTKGFKIGGGIKSTTKGTLKLKFPVGELGFEQTLELPLTGEYNSSSTTGNTCANEKLWEITDNITVPPHSRVTSTLIIMKTEVRVPMELTTNLRGTNSSGEGSFPTSNGLFSYTTSARGTVGGIFVSYYVRPASALYNTSWPDKPATFNSIGSNESLNLLGSGYSDVVPSLYVTIRQDQTPLSGYPGETKTWYSDKVILRDGRIVTLPSNADVNMSQTAKIPYCDRS

SEQ ID NO: 443 - protein, 319 aa, Bacillus thuringiensis IBL 4222; identical to SEQ ID NO: 442

SEQ ID NO: 444 - protein, 1154 aa, Bacillus thuringiensis serovar tochigiensis BGSC 4Y1
MKEQEFKGMDVLSNAQKTETLPCDLNITGCSPNNFLNISEEIDANLVPYNAPSAITTSIEITSTLLSDLGVPGASTIGLLLGKLINLLWPGGENDKSVWTSLLNESEELVNQKIEDITVITNAETALRGMHRVLQSYRSALNSWINPKGERISPEAMRTTYISALTTLNNSMASFSVPKHELPLLTLYSQAANIYLYVAKDITIFGKEWGFTYRNPEREGDIEFYYNEFLKYTAEHSEYCIDWYNQGLNQLSQSNSRDWVKYNKYRREMTIMVLDIISLFSSYDGFLYPQKTKTELTRMIFTNPIVYEGKQQYTWHQLAPSFSEIEDSAVPKPDYFRVLRNLLIHTKSYGSGVSATNYWSSHDLTYSLTNTPIYHQVSFGNKSTNGDDKYNNFSLSGRDVYKIISIARQNGPSYTDFIVNQFEMQTLNTSNAKNVLSYNHPSEWSNRQTFDSTTELPVTTNPPTTYGDDKQYSHRLGFISEVQHSSSRPNLIPIYGWTHTSVNLDNRIYSDRITQIPAIKSSPDLGGNFQNIAKGPGFNGGYVTTARSVNALVDVLKLQVTLDQNSLAQKYRVRLRYASNKRVPATLFTNTSGDYKFELQPSEVAPNPPYTKYQSFRYIDIPGLVSFTSTTDVVTVYLDMRYAPVGSYVEVDRIEFIPSNEIAELEKSLEKMKQAVNALFAEGRNVLKLDVTDRQIDMLSNLIDCLPEDVEPSEKRNLLNAVRYAKRLSQSRNLFIDSDFKLFNTGNGWSGSQSISISEGNILFKGPYLRLLGSNDDGSIPTYLYQKIDESKLKAYTRYKVRGFIGESKDLELYIVRYDGNTHTVMNVPRPRISPSIVMDSCGIPDRCKTHIEFDVSDTLSTDGSSSDPHAFSYHIDIGDMDLNENLGIWVIFKISTPDGYATLGNIECVEEGPLVGGALAQIKKKEQKFKEKIIEIRANTQRIYTEAKQAINNLFTDPPQDTKLKLATSLVKILEADGIAQRIPEIYNQWLYNIQGMNYSLFQELNTRIYQALELYTLRNLVQNPRFLDELSNWNVTSNVSVQQISGIPVLVLSNWDAQVKQRIVLKEDCGYILRVTAKKEGVGAGNVNISDCVGNAETLIFTSCNDKSTNISFNYDTQSIEFFPDAEQVYIEITESEGTFYIQNIELFLMRE

SEQ ID NO: 445 - protein, 753 aa, Bacillus thuringiensis MO19
MSVVYYVKGGDIMDPFSNCSEKKYSDSNNNQELTVESSSFYSNTTNENMKKNYPPINKNFSRNSNDTVLDILNISQNNNIDIFAPYNNLHSIKDELQIRTVIPGGVIFSVTGNKFVDSKFTAITYAAITKLTSSLITAAATAILGPIGTTIGGAISGPIANALFGLIPGMKPLTPQEIIDIAVEQSKLYTDEQITNLVITNATSELASIKAKIEDFNSQLNFALNSKNDNLMNRIDFETFLVTLENDIYGSIIKLMNFGYSKQLLPIITVCCTLNLSFLRDAIFNSQTFNISTQGKRVLTDTFERRTIEYSDKIINEYTLLFNEIKLKENAKTTLDFRTFMSLQVLDQVDLWSVFKFSQFNIRNTRRLYTIPYQYSENDVSKLDPTQINGDWKFINQILYGLPGNRISGFAGTVELYQPNKIRRINKLKALYSNNETTGYVGKDANAMDSFDTHPIISQKPAIINYASHVIVNLPPSSVQNLTLLDTIGPIFPGKYVINQQLYPGLNSLLEYEKFAIPDHKGVNVAGLPNIDSSYTSSTIDNLRQNFITSKPILGSVTAFQKDIPNYEQVNNKEQIVHLCPTDTDQKLLGFNIPALEYSKDRIANFGFEETWMIIPSYSSSGDNLQFKGTTAGIKYYLKSAQNAYANYKIFIKIAYKPNNSGNKVQLNINMKDLTSSSIISATLNIQNTSLLKGTSEDNVKFITFEVPTNFPISNNTYELQLIFTNLQQNDDLRLNELILHPINNDFINILNA

SEQ ID NO: 446 - protein, 305 aa, Bacillus thuringiensis tohokuensis
MAIFDVEADLIDNNKWYAQKYYNANPSTFRNPIVYDMNVSDLDVVPITTEFSSTPQLTNSATQVVRNNTSKDQSQTVLFSEKSIETFSRSTTEGYKIGSSIKSTTSFKVKVGFLVSGEINQSIEVAITGEYNHSSTETTTTTNEKLWQVTQPVIIPPYTQVTATLQIFSGPFVVPAKTKATIQGKGTNNGAYNFASAITYTDNSGRVYTDRNRAQALYTDRNEWPGYKRIYVGGSSSTDPTGLLRLEGEARITAQVGLYAVTEFRESPLPGYAGVGSNRTYYAPNILLGDGSVIQFPEYQRYLQR

SEQ ID NO: 447 - protein, 1060 aa, Bacillus thuringiensis serovar pakistani str. T13001
MADNNLQYTPPLRLDAEEYVPWKDVDSDVIIDAVAGAEGALFNLLIPGSGKIVEWGVSKFLKWATGDTYKPPSLSQEITRVEGMIATLQQQMYNVISATKAEILQNVAGLFFSNVVSAVNDYHHYLERWLDNSDDSNRLAELKSSLDKAIDEAHKAVSASYYNQNAQYTFAYNVNAATFSLILMRDKYLNYTQWGYGDAAGAQNFYEGTFLYRLKDYTTNILTQYNAILKLVHDLAVNPYSEPYREVTNRNPLQVTTNPLYNGKSDQRSMYWPSAYYGGSDNMRKKCISPMASDPYKHFSDSRIENQWNDDQHRSCQTPLPNGGLEMQINMPDQLKLSFQWNAYNRTRNVLTQTGLDFIAIWPYFDPIQYPPGEVTADLTRMLYSDLAGAITKNDIQSVDDIDNHVKKQSDLFEFLKSSKLYTKNVKVQTQQGPPFAYDSSTVKTHVDGDIIVGIENTTERTLETNTRNPGGIQGSSSDNADTIDPTEASKSVSISQWLFPRIFNFNGKVIGSVNETTPGNVTGIYNNLTYDFTLPEHQISWLSYVQAQENVLRPTNGYDYLTGNLTAANQGQIGALAIGWTKANIDANNTVKKGTITSIPAVKSHSITDWGTGTVVKGPGHTGGDLVKLPPNTRAKMIVTIEDTSTSYDVRIRYAAPSGGHIQFSYWNGGSDVKVADTQLQNTGGNTNFEHFQYAMLTTDNAKFKAPFSPVEILIENIGDSDVYLDKVEFSVLGQLPPGATPLTSQYMNPYGYNILWQSKNGEAANQGMVTFSQNDSAIKTFYLYNTEVVHQTTGSPSRWNGKFDTLYVQSPTSINLTQGFIVIDTTKNNPEPPIALPNQDILRPFTNEHEIWNGRYSTKALNLSLSTSSGAEGKIKFYNNTNLVHESPALSGSPSEPYTWEGSFNRITVYQSNSSDSNYFNLFGGFLKLDPNSNDNGNNGGPHNDCENIAHPDQPLYYESNNLIWTAAPNKLAYSTTEMQFVLSGGLGFTPGDIGAKIKLNFWKNDSIQYVAYGAVANLDFISAPAQSIPGGFDKITMDNDEYSFSTSLRMTLGSVCY

SEQ ID NO: 448 - protein, 781 aa, Bacillus thuringiensis serovar andalousiensis BGSC 4AW1
MKNGGLQMSRNDSNNDLPMSVLSRSQSKYLMTNMPLSELIHLSEQEWLDMYRKWKPMSTLDIDAEIGVTAALGIISFILSVSNPVSAAAVGIASILVPILWPTPAASPDPDIVWKSMIKNVENLIDEKIAQLHYDLAFAKLNGLKAGMVEFNQAIENLNQNPSSSGLKEAVRTKYRSLDSLFTYSMPQFAVNTAEIQLLPVYVEAATLHLLHKRTGFNFGKSWDLDPIEVESLYNDLIRLTGTYTDHCIRWYNRGLENLNPSTNTINYKPANMRDCNKYPWVKYDQSEWYYVNPSPNMCTTALSENSCKESMNVYNTEATPRWYGYRASQGEYQGLENWNSYNAFRRNLTTLVLDIIAVWPTFDPKLYKYGIKAELTRKLYSDICGTTYRSDPSQNSVNAIESKIVSPPSFFEWLDQIDFHTIVRDQGPNVGDFTSGELLTGVQQTVRRTLANPSLKPLEGKAGEQPTKIVRLTPNTFDITEVSTKQWFEPREIVLKRAGTNILTVGTITDERPYWSSLDRGLIYPKVKIYDQTQKNNQIPKTADPNKPQSEWDYSHRLSWFWYYPIREDAPMTYPNDKQIGAMACVWTHMSVDPTNSIAPDKITQIPAVKGNGMYFGGEIIKGLDNTGGDLVKLYSTSDRNQLQVDLKIPARMNNISGYQIRIRYASKQSGDIYLELERSVNSQWRLSTIPPTYSGNNLTSNSFGYHDALVIASQENAHPATLRIRNNDSPSLNTEIIIDKIEFIPIEGSLEEYEAKQKLEKAREVVNILFDSGANFEKA

SEQ ID NO: 449 - protein, 1078 aa, Bacillus thuringiensis serovar tochigiensis BGSC 4Y1
MSDKKGDKCMKQKRNAMKNKINAQSSPWFPANHKNKVEILQKGMNGVFDKKLGLNISPFPKVLTTCMQIVLKSIQFKSTLDIQIKEIFNCLWPMNADSQFIWQLCIAHLESLIQFDMPKSLKHNIFKRLQNIENEMKVYEKSFDEWQRTSNENVKKQELKKIIFNIESFLEECIRFFAMEKYELLLLVIYAQIANLHLLILRISLIYGEELDLTQEEQSVYQNKLISKIKLYTNYCTHQYKRGLFRIKKMQDYSCNSIEKWNLFNAYQKDMTLMVLDIISIWPTYDYSRYPMKTKIELTREIWTDIQYVSIENDKANLNKEVDFTLCTEPQIFEWLSTLEFYMRNSSNTSEFMGNIVGIHYSSYKTHHRKQHISRWWGEKSKYDYKLTVQNLQEYPVYNSIAQNSYESNQKVIKYIEKESQLLYHRLSRISGVIECPDKTNVSAITFAWAHVSVQETHDIDNKKLIIQIPASKAWSDETGKLRVIDGISTGGPLVLLEDTPLTISLNSKILHHLRIRYACNNNGVLRISKKPKLGSLSECIAEQAYKTTYEGSERDLVFESFDYLDFDFLLGETTSPYLIILERIQGTSPLIIDKIECIPVCITKRQHENNQYIKEAQKAVNQLFTNSLKNKLKFETTDYNVDQTAKKVESIYDSISLKEKVSLLRDVKHAKRLSKYRNLISNEDFGLPELISKNSWQFTHHVRVSCSDPQFKGYFLEIPSVKNVSLNEKDLFRNVYQKIDESKLKPYTRYIVRGFIGHCEDLEIWVTRYEKEVMSLQNVNNIVNNNGSVSHDTSHYFKVHIDVGNLDIEENLGIWVAFQITSPNGSATLGNIELIEMMPLSGKLLTQIKNTEEEWKKEKERRQLESNKSIQIANKAVKGLFDSSQEKKLNIVTSKKDILDALEKVENITYVYHSYLHNVVGNNFNVYKQLQERINRAFDLYQSRNKIMNGDFSRKDLGWNITPGIEFLKEEYRYFSLFIKHWSSSAVQEIELKSTCEYLLRVTGTKKAAGTGYVVCSGCASEYIQALFFTASEGERITKTIEVFPKTNRVQIEISTTNGTFLVESIELICLEDEKID

SEQ ID NO: 450 - protein, 475 aa, Bacillus thuringiensis PS52A1
MIIDSKTTLPRHSLIHTIKLNSNKKYGPGDMTNGNQFIISKQEWATIGAYIQTGLGLPVNEQQLRTHVNLSQDISIPSDFSQLYDVYCSDKTSAEWWNKNLYPLIIKSANDIASYGFKVAGDPSIKKDGYFKKLQDELDNIVDNNSDDDAIAKAIKDFKARCGILIKEAKQYEEAAKNIVTSLDQFLHGDQKKLEGVINIQKRLKEVQTALNQAHGESSPAHKELLEKVKNLKTTLERTIKAEQDLEKKVEYSFLLGPLLGFVVYEILENTAVQHIKNQIDEIKKQLDSAQHDLDRDVKIIGMLNSINTDIDNLYSQGQEAIKVFQKLQGIWATIGAQIENLRTTSLQEVQDSDDADEIQIELEDASDAWLVVAQEARDFTLNAYSTNSRQNLPINVISDSCNCSTTNMTSNQYSNPTTNMTSNQYMISHEYTSLPNNFMLSRNSNLEYKCPENNFMIYWYNNSDWYNNSDWYNN

SEQ ID NO: 451 - protein, 475 aa, Bacillus thuringiensis YBT-1518; identical to SEQ ID NO: 450

SEQ ID NO: 452 - protein, 475 aa, Bacillus thuringiensis 96418
MIIDSKTTLPRHSLIHTIKLNSNKKYGPGDMTNGNQFIISKQEWATIGAYIQTGLGLPVNEQQLRTHVNLSQDISIPSDFSQLYDVYCSDKTSAEWWNKNLYPLIIKSANDIASYGFKVAGDPSIKKDGYFKKLQDELDNIVDNNSDDDAIAKAIKDFKARCGILIKEAKQYEEAAKNIVTSLDQFLHGDQKKLEGVINIQKRLKEVQTALNQAHGESSPAHKELLEKVKNLKTTLERTIKAEQDLEKKVEYSFLLGPLLGFVVYEILENTAVQHIKNQIDEIKKQLDSAQHDLDRDVKIIGMLNSINTDIDNLYSQGQEAIKVFQKLQGIWATIGAQIENLRTTSLQEVQDSDDADEIQIELEDASDAWLVVAQEARDFTLNAYSTNSRQNLPINVISDSCNCSTTNMTSNQYSNPTTNMTSNQYMISHEYTSLPNNFMLSRNSNLEYKCPESNFMIYWYNNSDWYNNSDWYNN

SEQ ID NO: 453 - protein, 395 aa, Bacillus thuringiensis PS69D1
MILGNGKTLPKHIRLAHIFATQNSSAKKDNPLGPEGMVTKDGFIISKEEWAFVQAYVTTGTGLPINDDEMRRHVGLPSRIQIPDDFNQLYKVYNEDKHLCSWWNGFLFPLVLKTANDISAYGFKCAGKGATKGYYEVMQDDVENISDNGYDKVAQEKAHKDLQARCKILIKEADQYKAAADDVSKHLNTFLKGGQDSDGNDVIGVEAVQVQLAQVKDNLDGLYGDKSPRHEELLKKVDDLKKELEAAIKAENELEKKVKMSFALGPLLGFVVYEILELTAVKSIHKKVEALQAELDTANDELDRDVKILGMMNSIDTDIDNMLEQGEQALVVFRKIAGIWSVISLNIGNLRETSLKEIEEENDDDALYIELGDAAGQWKEIAEEAQSFVLNAYTP

SEQ ID NO: 454 - protein, 808 aa, Bacillus thuringiensis MC28
MTKKHKKILSMTLATGVFAGTYIPTAYTAFAETEPKEDLNEKKTKNINQNNPSIDLKGWFENPYKGVTFDQFINAFNNNAWNPLLVDIKNNGNAGSGTLVFLKGMMGTGLSLLPPPASLLGSIWTIFMPSTNGGTDMWRQLETYIDEKIDSKINDYHKYLMGAEFNGAMSAIKEYQRVLQIYNDSKNSLKRVEAPGTGVITAARNADTALKAFISIIQTPEKETDSVYQQITAPIFVQAANAHLLLQRDMILYGEEWGMDKNQWQGYKDNQKKLIQEYTNYAMKVYNDGLEKKKKEAENINTQQPNRNTDKWNHINAYVREYTLSVLDFVDLFPATNPETYSKGIMQENSRQIYSSIKGAVIPQGGTGEGTTWENIQKILDSQEYKGDLHKLDIRSYDRIDAIQPWYSDKKNGGANWTTPGWTGNTNGGNLNPLINPLNNPITRVKAQSSRTPNYIDFKFDTGGNNPSFGRYVSGHASYKEDIFEYPNQKLSQVHAFNTSTYPGFQGIDAVVFGFVDKNLTQSSTYLMTNMITAIPAAKYNRGMSNFQPQVESIHAKQKAMKTDTTNSYLAYGVEVSKEQEYKIRYKVAANENSKISLSHRKPGGNYAKIDDTTIPITRNFADTVKGEYGSYKIVEGPTVKLTKGTHDLKLENSQGKFSVDQIELEPVEQDQVIAQDNFDDKRLSWVNLGGIVNGGVTGKAGMIDANGNTWSYIQDQVLPFSKYTLSIKVKLNSNNGNERQKVTLYTDNLKHERITKTVELKGNAGYQEIQLEFITRKDSANTHVGILTSNGASNILFDDVKVIGAKK

SEQ ID NO: 455 - protein, 815 aa, Bacillus cereus AH603
MGTGDFMTKKQKKILSITLATGVFAGTYIPTAYTAFAENEKKEDLQENQTKNINQNSLPIDSYGWFENPYKGVTFSQFIDAFNNNQWQPLLVNIKNKGDAGSGTISFLKGMMTTGLSLLPPPASLLASIWSVFIPTNDANGTDMWRQLEIYIDEKIDSKINDYHKYLMGAEFNGAMSAIKEYQRVLQIYNDSKNSLKRVEEPGTPVIEAVRAADRKLKEFIAVVQTPEKSNDSVYQQITAPIFVQAANAHLLLQRDMILYGEEWGMDKDQWQGYKDNQKKLIQEYTNYAMKVYNDGLEKRKKEAEEINTQQPNRNTDRWNHINDYVREYTLSVLDFVDLFPATNPETYSKGVMQENSRQIYSSIKGAVIPQGGTGEGTTWENIQKILDSQEYKGDLHKLDIRSFDRIDAIQPWFSDKQNGGSNWTTPGWTGNASGGALKNLINPSDNPITRVKAQSSRTPNYIDFKFDTGGDNPYFGRYFSGGSYKEDIFEYPNQKLSQIHAFNRSTYPGFEGIDAVVFGFVDKNLTQSSTYLMTNMITTIPAAKYNRGMSNFQPQVESIHAKQKAMKTDTTNSYLAYGVEISKEQEYKIRYKVAANENSKISLSHRKPGGNYAKIDDTTIPITGNAADTVKGEYGSYKIVEGPIVKLTKGAHDLKLENSQGKFSLDQIELEPVERDQVIARDNFDDQRLNWINLGGIVNGGITGKAGMIGTNGDTWTYIQDQVLPFSKYTLSIKVKLDSSDGNERQKVTIFTDNLKHERITKTVELKGKAGYQEMQLEFITSRDLANTHVGILTSNGTSNVLFDDVQVIGAKKS

SEQ ID NO: 456 - protein, 1138 aa, Bacillus thuringiensis galleriae PGSI245
MNLNNLDGYEDSNRTLNNSLNYPTQKALSPSLKNMNYQDFLSITEREQPEALASGNTAINTVVSVTGATLSALGVPGASFITNFYLKIAGLLWPENGKIWDEFMTEVEALIDQKIEEYVRNKAIAELDGLGSALDKYQKALADWLGKQDDPEAILSVATEFRIIDSLFEFSMPSFKVTGYEIPLLTVYAQAANLHLALLRDSTLYGDKWGFTQNNIEENYNRQKKRISEYSDHCTKWYNSGLSRLNGSTYEQWINYNRFRREMILMALDLVAVFPFHDPRRYSMETSTQLTREVYTDPVSLSISNPDIGPSFSQMENTAIRTPHLVDYLDELYIYTSKYKAFSHEIQPDLFYWSAHKVSFKKSEQSNLYTTGIYGKTSGYISSGAYSFHGNDIYRTLAAPSVVVYPYTQNYGVEQVEFYGVKGHVHYRGDNKYDLTYDSIDQLPPDGEPIHEKYTHRLCHATAIFKSTPDYDNATIPIFSWTHRSAEYYNRIYPNKITKIPAVKMYKLDDPSTVVKGPGFTGGDLVKRGSTGYIGDIKATVNSPLSQKYRVRVRYATNVSGQFNVYINDKITLQTKFQNTVETIGEGKDLTYGSFGYIEYSTTIQFPDEHPKITLHLSDLSNNSSFYVDSIEFIPVDVNYAEKEKLEKAQKAVNTLFTEGRNALQKDVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSPECSSMQDGILSDSHSFSLNIDTGSINHNENLGIWVLFKISTLEGYAKFGNLEVIEDGPVIGEALARVKRQETKWRNKLAQLTTETQAIYTRAKQALDNLFANAQDSHLKRDVTFAEIAAARKIVQSIREAYMSWLSVVPGVNHPIFTELSGRVQRAFQLYDVRNVVRNGRFLNGLSDWIVTSDVKVQEENGNNVLVLNNWDAQVLQNVKLYQDRGYILHVTARKIGIGEGYITITDEEGHTDQLRFTACEEIDASNAFISGYITKELEFFPDTEKVHIEIGETEGIFLVESIELFLMEELC

SEQ ID NO: 457 - protein, 1138 aa, Bacillus thuringiensis dakota HD511
MNLNNLGGYEDSNRTLNNSLNYPTQKALSPSLKNMNYQDFLSITEREQPEALASGNTAINTVVSVTGATLSALGVPGASFITNFYLKITGLLWPHNKNIWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAFRTPHLVDYLDELYIYTSKYKAFSHEIQPDLFYWCVHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYSRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREVYMSWLSVVPGVNHPIFTELSGRVQRAFQLYDVRNVVRNGRFLNGLSDWIVTSDVNVQEENGNNVLVLNNWDAQVLRNVKLYQDRGYVLRVTARKIGIGEGYITITDEEGHTDQLRFTACEEIDASNAFISGYITKELEFFPDTEKVHIEIGETEGIFLVESIELFLMEELC

SEQ ID NO: 458 - protein, 1138 aa, Bacillus thuringiensis kumamotoensis 867
MNLNNLGGYEDSNRTLNNSLNYPTQKALSPSLKNMNYQDFLSITEREQPEALASGNTAINTVVSVTGATLSALGVPGASFITNFYLKITGLLWPHDKNIWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWEFTQNNIEENYNRQKKHISEYSNHCVKWYNSGLSRLNGSTYEQWINYNRFRREMILMVLDIAAVFPIYDPRMYSMETSTQLTREVYTDPISLSISNPGIGPSFSQMENTAIRTPHLVDYLDELYIYTSKYKAFSHEIQPDLFYWSAHKVSFKQSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKITKIPAVKMYKLGDTSTVVKGPGFTGGDLVKRGSNGYIGDIKATVNSPLSQNYRVRVRYATNVSGQFNVYINDKITLQRKFQNTVETIGEGKDLTYGSFGYIEYSTTIQFPDKHPKITLHLSDLSNNSSFYVDSIEFIPVDVNYDEKEKLEKAQKAVNTLFTEGRNALQKDVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDIGSINHNENLGIWVLFKISTLEGYAKFGNLEVIEDGPVIGEALARVKRQETKWRNKLAQLTTETQAIYTRAKQALDNLFANAQDSHLKIDVTFAEIAAARKIVQSIREAYMSWLSVVPGVNHPIFTELSERVQRAFQLYDVRNVVRNGRFLNGLSDWIVTSDVKVQEENGNNVLVLNNWDAQVLQNVKLYQDRGYILRVTARKIGIGEGYITITDEEGHTVQLRFTACEVIDASNAFISGYITKELEFFPDTEKVHIEIGETEGIFLVESIELFLMEELC

SEQ ID NO: 459 - protein, 1138 aa, Bacillus thuringiensis WZ-9
MNLNNLGGYEDSNRTLNNSLNYPTQKALSPSLKNMNYQDFLSITEREQPEALASGNTAINTVVSVTGATLSALGVPGASFITNFYLKITGLLWPHDKNIWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAIRTPHLVDYLDELYIYTSKYKAFSHEIQPDLFYWSAHKVSFKQSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKITKIPAVKMYKLGDTSTVVKGPGFTGGDLVKRGSNGYIGDIKATVNSPLSQNYRVRVRYATNVSGQFNVYINDKITLQRKFQNTVETIGEGKDLTYGSFGYMEYSTTIQFPDEHPKITLHLSDLSNNSSFYVDSIEFIPVDVNYDEKEKLEKAQKAVNTLFTEGRNALQKDVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDIGSINHNENLGIWVLFKISTLEGYAKFGNLEVIEDGPVIGEALARVKRQETKWRNKLAQLTTETQAIYTRAKQALDNLFANAQDSHLKIDVTFAEIAAARKIVQSIREAYMSWLSVVPGVNHPIFTELSERVQRAFQLYDVRNVVRNGRFLNGLSDWIVTSDVKVQEENGNNVLVLNNWDAQVLQNVKLYQDRGYILRVTARKIGIGEGYITITDEEGHTVQLRFTACEVIDASNAFISGYITKELEFFPDTEKVHIEIGETEGIFLVESIELFLMEELC

SEQ ID NO: 460 - protein, 1138 aa, Bacillus thuringiensis HQ122
MNLNNLDGYEDSNRTLNNSLNYPTQKALSPSLKNMNYQDFLSITEREQPEALASGNTAINTVVSVTGATLSALGVPGASFITNFYLKITGLLWPHDKNIWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLHGSTYEQWINYNRFRREMILMVLDIAAVFPIYDPRMYSMETSTQLTREVYTDPISLSISNPDIGPSFSQMENTAIRTPHLVDYLDKLYIYTSKYKAFSHEIQPDLFYWSAHKVSFKQSEQSNLYTTGIYGKTSGYISSGEYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKITKIPAVKMYKLDDLSTVVKGPGFTGGDLVKRGSNGYIGDIKATVNSPLSQKYRVRVRYATSVSGLFNVFINDEIALQRNFQSTVETIGEGKDLTYGSFGYIEYSTTIQFPNEHPKITLHLNHLSNNSPFYVDSIEFIPVDVNYDEKEKLEKAQKAVNTLFTEGRNALQKDVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSTNHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 461 - protein, 1145 aa, Bacillus thuringiensis monterrey GM-33
MNLNNLGGYEDSNRTLNNSLNYPTQKALSPSLKNMNYQDFLSITEREQPEALASGNTAINTVVSVTGATLSALGVPGASFITNFYLKITGLLWPHDKNIWDEFMTEVETLIEQKIEQYARNKALAELEGLGNNLTIYQQALEDWLNNPDDPATIHDVIDRFRILDALFESYMPSFRVAGYEIPLLTVYAQAANLHLALLRDSTLYGDKWGFTQNNIEENYNRQKKHISEYSNHCVKWYNSGLSRLHGSTYEQWINYNRFRREMILMVLDIAAVFPIYDPRMYSMETSTQLTREVYTDPISLSISNPDIGPSFSQMENTAIRTPHLVDYLDKLYIYTSKYKAFSHEIQPDLFYWSAHKVSFKQSEQSNLYTTGIYGKTSGYISSGEYSFRGNDIYRTLAAPSVVVYPYTQNYGVEQVEFYGVKGHVHYRGDNKYDLTYDSIDQLPPDGESIHEKYTHRLCHATAISKSTPDYDNATIPIFSWTHRSAEYYNRIYPNKITKIPAVKMYKLDDLSTVVKGPGFTGGDLVKRGSNGYIGDIKATVNSPLSQKYRVRVRYATSVSGLFNVFINDEIALQRNFQSTVETIGEGKRFNLWFIWIYREYSTTIQYIRIEHPERITRSFKTHLSNNSPCYCRSIEFIPVDVNYAEKEKLEKAQKAVNALFTEGRNALQKHVTDYKVDQVSILVDCISGDLYPNEKRELQNLVKYAKRLSYSRNLLLDPTFDCINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSSSLNIDTGSINHNENLGIWVWFKIPTLEGYAKFGNLEVDEDGPVIGEALARVKRQETKWRNKLAQMTTETQAIYTRAKQALEYLFANAQDSHLKRNVTFAEIAAARKIVQSIREAYMSWLSVVPGVNHPIFTELSGRVQRAFQLYDVRNVVRNGRFLNGLSDWIVTSDVKVQEENGNNVLVLNNWDAQVLQNVKLYQDRGYILHVTARKIGIGEGYITITDEEGHTDQLRFTACEEIDASNAFISGYITKELEFFPDTEKVHIEIGGTEGIFLVEGILEVFLRLESYVI

SEQ ID NO: 462 - protein, 1138 aa, Bacillus thuringiensis HQ122
MNLNNLGGYEDSNRTLNNSLNYPTQKALSPSLKNMNYQDFLSITEREQPEALASGNTAINTVVSVTGATLSALGVPGASFITNFYLKITGLLWPHNKNIWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAIRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKITKIPAVKMYKLDDLSTVVKGPGFTGGDLVKRGSNGYIGDIKATVNSPLSQKYRVRVRYATSVFGLFNVFINDEIALQKNFQSTVETIGEGKDLTYGSFGYIEYSTTIQFPNEHPKITFHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 463 - protein, 1138 aa, Bacillus thuringiensis GW6; identical to SEQ ID NO: 459

SEQ ID NO: 464 - protein, 1138 aa, Bacillus thuringiensis; identical to SEQ ID NO: 459

SEQ ID NO: 465 - protein, 1138 aa, Bacillus thuringiensis QG-121
MNLNNLGGYEDSNRTLNNSLNYPTQKALSPSLKNMNYQDFLSITEREQPEALASGNTAINTVVSVTGATLSALGVPGASFITNFYLKITGLLWPHDKNIWHEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWEFTQNNIEENYNRQKKHISEYSNHCVKWYNSGLSRLNGSTYEQWINYNRFRREMILMVLDIAAVFPIYDPRMYSMETSTQLTREVYTDPISLSISNPGIGPSFSQMENTAIRTPHLVDYLDELYIYTSKYKAFSHEIQPDLFYWSAHKVSFKQSEQSNLYTTGIYGKTSGYISSGAYSFRGNDIYRTLAAPSVVVYPYTQNYGVEQVEFYGVKGHVHYRGDNKYDLTYDSIDQLPPDGESIHEKYTHRLCHATAISKSTPDYDNATIPIFSWTHRSAEYYNRIYPNKITKIPAVKMYKLGDTSTVVKGPGFTGGDLVKRGSNGYIGDIKATVNSPLSQNYRVRVRYATSVFGLFNVFINDEIALQKNFQSTVETIGEGKDLTYGSFGYIEYSTTIQFPNEHPKITFHLNHLSNNSPFYVDSIEFIPVDVNYDVNYAEKEKLEKAQKAVNALFTEGRNALQKHVTDYKVDQVSILVDCISGDLYPNEKRELQNLVKYAKRLSYSRNLLLDPTFDCINSSEENGWYGSNGIVIGNGDFVFKGNYLIFSGTNDTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 466 - protein, 1154 aa, Bacillus thuringiensis huazhongensis
MDIRNQNKYEVVYPAINETTSNTTSKYPLASDPIKQYQNMNYKDSLNIIEGNNVITPVSGTAVLATARKIGGKIVKAIGEQILSKILKEILDYLWPSSSSSNSWEEMMKEVEYLIDKKIEEYARNKALAVLEGIGNAVESYYSALEAWELESSERSLELVLERYQFAVQFARSSMPSFAIINYEIPLLATYANAANVHLLLMRDIQIYGDRWGISQNDMNLFLKEQEIYTSEYSEHCVKWYNEGLNQLKTKGGASGLVWENYNSFRTEMTIMVLDLVAIFPAYNMSKYPIESTVELTRTIYTDPLGYTGYSNDEHPTYYSSAKPFSSIESRAVLAPSLFKWITQLEVYTKKYSYSSQYTTLWTGLRVIAQPTKDFTDTVYDYGSSSGSENKDVFDLYGNDVYDTQSVVSSYKPTGGGHFGVPQFRLFWITKSNGLREQIFNYANNMGSYSAYRFSKDELPIELLQPPLFGDIEEYSHRLSHVSEVIKDYGEGIIPVLGWTHVSVTRDNRIYPDKITQLPAVKMYELLSSAVVVKGPGFTGGDLVKRTGNGGIGHFNVSVESPGTQRYRLRIRYSSEVSGVFHMQINDIETIQGEFSSTADSTSTLSSEAFQLREYSTTFTFPTNMTKIKVSLGAIEGAGGFYLDRIEFIPVDENHDNRVTLEKAQKAVNALFTAGRNALQTDVTDYKVDQVSILVDCVSGELYPNEKRELLSLVKYAKRLSYSRNLLLDPTFDSINSSDENGWYGSNGIAIGNGNFVFKGNYLIFSGTNDTQYPTYLYQKIDESKLKEYTRYKLRGFIENSQDLEAYVIRYDAKHETLDVSNNLLPDISPVNACGEPNRCAALQYLDENPRLECSSIQDGILSDSHSFSLNIDTGSIDFNENVGIWVLFKISTPEGYAKFGNLEVIEDSPVIGEALARVKRQETKWRNKLTQLRTETQAIYTRAKQAIDNVFTNAQDSHLKIGTTFAAIVAARKIVQSIREAYMSWLSIVPGVNYPIFTELNERVQRAFQLYDVRNVVRNGRFLNGVSDWIVTSDVKVQEENGNNVLVLSNWDAQVLQCLKLYQDRGYILRVTARKEGLGEGYITITDEEGHTDQLTFGTCEEIDASNTFVTTGYITKELEFFPDTEKVRIEIGETEGTFQVESIELFLMEDLC

SEQ ID NO: 467 - protein, 1144 aa, Bacillus thuringiensis BTH-13
MDKQNDSGIIKATLNEDFSNSIQRYPLVTDQTINYKDFLNMNEEIAPYASSKDVIFSSISIIRTFMGFAGHGTAGGIIGLFTEVLRLLWPNKQNDLWESFMNEVEALINQEITEAVVSKALSELEGLRNALEGYTSALEAWQNNRSDKLKQLLVYERFVSTENLFKFAMPSFRSVGFEGPLLTVYAQAANLHLFLLKNAELFGAEWGMQQYEIDLFYNEQKGYVEEYTDHCVKWYKEGLNKLKNASGVKGKVWENYNRFRREMTIMVLDLLPLFPIYDARTYPMETVTELTRQIFTDPIGLTGINETKYPDWYGAASSEFVLIENRAIPKPGLFQWLTKINVRARVVEPNDRFAIWTRHSVVTQCTKSTTENTFNYGTSSGSTLSHTFDLLSKDIYQTYSIAAANKSATWYQAVPLLRLYGINSSNVLSEDAFSFSNNIPSSKCKSTYSSDQLPIELLDEPIYGDLEEYGHRLSYVSEIFKETGSGTIPVLGWTHVSVRPDNKLYPDKITQIPAVKAFETNTAGVEIIDSASTGGPILKIVNNNLPSNQVFRMRLSFSEPQKIKVRVRYAATGDGVMSFSGIAHDEYFTATMKEGEALKYSYLTMGNDYAGTAAELSMLYIIKANTSNCTIYIDKIEFIPVDENYNNRVQLEKAQKAVNTLFTAGRNALQKDVTDFKVDQVSILVDCVSGELYPNEKRELLSLVKYAKRLSYSRNLLLDPTFDSINSSEENGWNGSNGIAIGSGDFVFKGNYLIFSGTNDEQYPTYLYQKIDESKLKEYTRYKLRGFIESSQDLEAYVIRYDAKHETLDVSNNLLPDIPPVNACGEPNRCAALQYLDENPKLECSSIQDGILSDSHSFSLHIDTGSIDFNENVGIWVLFKISTPEGYAKFGNLEVIEDGPVIGEALARVKRQETKWRNKLTQLRTETQAIYTRAKQALDNLFTDAQDSHLKIGATFAAIVAARKIVQSIREAYMSWLSDVPGLNYPIFTELNDRVQRAFQLYDVQNVVRNGRFLNGVLDWIVTSDVKVQEGNGNNVLVLSGWDAQVLQCLNLYQNRGYILRVTARKEGLGEGYITITDEEGNTDQLTFGSCENIDSSNSFVSTGYITKELEFFPDTDQIQIEIGETEGTFQVESVELFLMENLC

SEQ ID NO: 468 - protein, 1144 aa, Bacillus thuringiensis LH-2
MDQQNEYEIIQAGVSNAITDTFQRYPLANNPNTSFQNMNYKDYLNDPMFLGETRDAQTAITTSLEIISEILGFLGVPFVGPIIGFTNRLINLLWPRNTTDIWNAFMDEVQALINESITKAVRSKAISELEGIHQVYRLYIEALNEWKDTPDNPFVQERVRTTFRDVNSIINYAMPSFRVQGFEIPLLVVYAQAANLHLVLLRDATLFGAGWGFTETNINDRYNEQVRVTNGYIDHCTKWYNEGLTRLKNNWSKYHQFRREMTLMVLDLIALFPSHDARRYPMETSAQLTRDVYTDPIGYRGNANFSDPWTNHVSFSKAESETIRPPHLFDTLESVEINTAKAMLPLNDKSYMYYWAGHTVTSRLLDSSGNPLKYTYGSMTSEKNLVSLPGKDVYRINSVASGFSNYYAKLYGVSKVDFSIVDRNNSNKTTYSYSKSSTVPSDNKENRDSENELPQTTTDQPDYKGYSHRLSHITFISSAIPTYVWTRKSADLTNTIYPDKITQIPAVKMYELGSSAVVVKGPGFTGGDLVKRTNNGSLGRFKITIDSPGAHRYRLRVRYHSDVSGVFHMQINNVETIQGEFKSTVDSTSTMSNDSFQLREFTTTFRFPSNVTDIKVSLGAINGQGNFYLDRIEFAPVDTNYDERITLEKAQKAVNALFTEGRNALQTDMTDYKVDQVSILVDCVSGEVYPNEKRELLNLVKYAKRLSIARNLLVDPNFTSIHASMYSEDVKGWYGSNGIATGSGDVVLKENYVSLPSTSDAQYPTYLYQKIDESKLKAYTRYKLRGFIENSQDLEAYVVRYDAKHETLDVSNNLLPDVLPVNACGEPDRCAALQYLDENPRLECSSIQDGILSDSHSFSLNIDTGSMDLNENLGIWVLFKISTPEGYAKFGNLEVIEDGTVSGEALARVKRQETKWRNKLAQLRTETQAIYTRAKQALDNLFTDAQDSYLKIGATFAAIVAARKIVQSIREAYMSWLSVVPGVNYPIFTELNERVQRAFQLYDGRNVVRNGRFLNGVLDWIVTSDVSVQEENGNNVLVLSNWDAQVLQCLKLYQDRGYILRVTARKEGLGEGYITITDEEGNTDQLTFGSCEEIDTSNSFVSTGYMTKELEFFPDTEKVRIEIEETEGTFKVESVELFLMEDLC

SEQ ID NO: 469 - protein, 1157 aa, Bacillus thuringiensis serovar tochigiensis BGSC 4Y1
MDTRNQKKYEELQPALNDTFSNTAPKYPLACDPTKQCQNMNYKDYLNMTEGGAPYVSSRDVIFSSLAITRTFLGLAGLGTAGGMIGLFTEALRLLWPNKTEDLWKAFMDEVEKLINQKITDAVVSKALSELQGLANALEGFTNALEAWQNNRSDKLQQLLVYERFVATETLFKYAIPSFRVSGFEVPLLTVYAQAANLHLCLLKNAELFGADWGMPQYEIDVFYNEQKGYIEEYTDHCVTWYNSGLNQLKNVSGVKGKVWENYNRFRREMTIMVLDILPLFPIYDTRTYLMETTIELTRQIFTDPIGLTGINETKYPDWYEAASTEFILIENNAVPKPTLFQWLTKFNVWGRTVNPNDTFTIWTGHSVVTRYTKDSAEHTFNYGTSSGSTLSYTFDLLSKDVYQTYSLAETNKSATWYFAVPMLKLYSINNNNKLSEEYFSFPTNIPSSKGKRTYSSDQLPIELSDSPIYGDLEEYSHRLSYVSEIFKKTGSGTIPVLGWTHVSVSPDNRIFTDKITKLPVVKATQLSGEVITGPGFTGGNIIKSNVASTEPTKIIVLLNISPPSSKTKYSFRIRYAADAPGRLQITDGNYIAGLTQEFKATMEVGSSLKYNSFQYLTFSTGSLGTGSNYLKIYALQSPSSFSYNIYIDSIECIPVPVNYDDSVTLENAQKAVNALFTASSNALKREVTDYVVDQASILVDCVSEELYPNEKRELLHLVKYAKRLSAVRNLLLDPTFESINSSDVNGWYGSNGIAIGSGDFVFKGKYVSLPGTNDERYPTYLFQKIDESKLKEYTRYKLRGFVESSQDLEVYVIRYDAKHETLHVSDNLIPNVPPVNECGEPNRCAQQQYLSGNPTLEQYYVTKGVLYDSHAFSLDIDTGSVDPNEHLGIWVLFKISTTRGFAKLGNVEVIEDGLLTGEALARVKRKETKWKNKLEQLRAETQAISTRANQALDSLFADAQDSKLKLGVTFATIVAARKIVQSIRDVYMPWLSIVSGVNYSIFTELMGRVQLALQLYDLRNMVRNGRFLNGISDWGVTSDVKVQEEDGNLVLVLSNWDAQVLQCVKLYPDRGYILRVTARKEGLGEGYVTICGEEGNTDTLTFGTCDDTDRLQSVVSTGYVTKELEFFPDTENVQIEIGETEGVFQVESVELFLMEE

SEQ ID NO: 470 - protein, 1117 aa, Bacillus thuringiensis serovar tochigiensis BGSC 4Y1
MRVNRNELRTLPEGFASSTESAVTNTLNIISIILDATGHPVAGKVLGVITGILGILWPGGSEKAWEEFMEAVEQLVDEKITDAFKSEALSKLDGLSQLYNVYLSELELWIERPNDPSVIQSVRTRFLDLDSEFISSMPQFAINGFEIQFLPVYAHAANLHLLLLRDLSYYGKNWGLQEPEIENFYKRQMDNIQKYTDHCVEWYERGLQEVYNSFTSTNINEDGGLPWTHYNRYRREMTVYVLDLIATFPTNDWKKYHLETNVELSREIYTDPLGYEDDDTEDITDVDWYSEGVSFSEIENMHPPRLVEWLNKVYIYTDYFEAGSDESYAWVSHIITSSFTDSNEEHSRSYGSTESVEESEGISFYPAEIYKVVSVVGSERNATYDNYVNSANTFYGVTPTNELKTFTYSYRNDYDKKTLYSDDQLPLETDTPKYGEYSHRLSNITIAPLNSDDFGLVPILGWTHTSLKRENRIYPDKITQIPAVKSVEGGVVVKGPGFTGGNLIKAETTQGQIVKIVKFKVKVDGSLSQKYRVRVNYAANSDGRIDFYFAGQVVLQSDFIKTMDNNDISKFSSFGYLDIDFPFNFSHSELEVLSQISLKTTGVFYINNIEFIPEIEGYDEKVTLEKAQKAVNALFTAGRNAIQTDVTDYKVDQVSNLVDCVSEELYPNEKQELQNLVKYAKRLSISRNLLLDPNFTSINAPKVRGWHGSPGIIVGNGNYIFKGPYVHLQGTNDAQDPTYLYQKIDESKLKEYTRYKLRGFIESSQDLEVSVIRYDAKHETVDVSDNLLSDNLPKNACGEPNRCILQQYIENNPTLECSSIQDGILFDSHSFSLNIDTGSINYNENVGIWVVFKISTLEGYAKVGNIEVIEEAPLVGEALARVKRQETKWRNKLEQLRAETQVIYTRAKQAIDNLFTDIQDSKLKMEVTFATIVAAREIVQSIREAYMPWLSVVPGVNYPIFTELNVRVRRALQLYDLRNVVRNGRFRHGLSNWIVTSDVKIQEENGNNVLVLSGWDAQVLQHVKLYPDRGYILRVTAHKEGLGEGYITIMDEEGHTDQLTFGACEKIDASNTFMSTGYITKELEFFPDTEKVHIEIGETEGIFKVESIALFLMEEQC

SEQ ID NO: 471 - protein, 1157 aa, Bacillus thuringiensis kumamotoensis
MSPNNQNEYEIIDATPSTSVSSDSNRYPFANEPTDALQNMNYKDYLKMSGGENPELFGNPETFISSSTIQTGIGIVGRILGALGVPFASQIASFYSFIVGQLWPSKSVDIWGEIMERVEELVDQKIEKYVKDKALAELKGLGNALDVYQQSLEDWLENRNDARTRSVVSNQFIALDLNFVSSIPSFAVSGHEVLLLAVYAQAVNLHLLLLRDASIFGEEWGFTPGEISRFYNRQVQLTAEYSDYCVKWYKIGLDKLKGTTSKSWLNYHQFRREMTLLVLDLVALFPNYDTHMYPIETTAQLTRDVYTDPIAFNIVTSTGFCNPWSTHSGILFYEVENNVIRPPHLFDILSSVEINTSRGGITLNNDAYINYWSGHTLKYRRTADSTVTYTANYGRITSEKNSFALEDRDIFEINSTVANLANYYQKAYGVPGSWFHMVKRGTSSTTAYLYSKTHTALQGCTQVYESSDEIPLDRTVPVAESYSHRLSHITSHSFSKNGSAYYGSFPVFVWTHTSADLNNTIYSDKITQIPAVKGDMLYLGGSVVQGPGFTGGDILKRTNPSILGTFAVTVNGSLSQRYRVRIRYASTTDFEFTLYLGDTIEKNRFNKTMDNGASLTYETFKFASFITDFQFRETQDKILLSMGDFSSGQEVYIDRIEFIPVDETYEAEQDLEAAKKAVNALFTNTKDGLRPGVTDYEVNQAANLVECLSDDLYPNEKRLLFDAVREAKRLSGARNLLQDPDFQEINGENGWAASTGIEIVEGDAVFKGRYLRLPGAREIDTETYPTYLYQKVEEGVLKPYTRYRLRGFVGSSQGLEIYTIRHQTNRIVKNVPDDLLPDVSPVNSDGSINRCSEQKYVNSRLEGENRSGDAHEFSLPIDIGELDYNENAGIWVGFKITDPEGYATLGNLELVEEGPLSGDALERLQREEQQWKIQMTRRREETDRRYMASKQAVDRLYADYQDQQLNPDVEITDLTAAQDLIQSIPYVYNEMFPEIPGMNYTKFTELTDRLQQAWNLYDQRNAIPNGDFRNGLSNWNATPGVEVQQINHTSVLVIPNWDEQVSQQFTVQPNQRYVLRVTARKEGVGNGYVSIRDGGNQSETLTFSASDYDTNGVYNDQTGYITKTVTFIPYTDQMWIEISETEGTFYIESVELIVDVE

SEQ ID NO: 472 - protein, 1180 aa, Bacillus thuringiensis B-JJX
MSPNNQNEYEIIDATPSTSVSNDSNRYPSANEPTNALQNMNYKDYLRISEGYDSEYSGSPGAFISEKDAIKVGIDIVGNILGKLGVPFASQIVSFYNFILDQLWPSNSVSVWEQIMTLVEELVDQKITEYARNKALAELKGLGDALGVYQQSLEAWLENRNDTRARSVVSNQFIALELDFVGAIPSFAVSGQEVPLLAVYAQAVNMHLLLLRDASIFGEEWGFTSSEISTYYNRQVQLTSQYSDYCVKWYDTGLQKLKGTSAESWLEYHQFRREMTFMVLDLVALFPNYDTHTYPLETKAQLTREVYTDPIAFNLSGAAGFCRPWSKYTGISFSEIENAVIRPPHLFNVLRSLEINTVRGTILGNTKDYLNYWSGHSLQYNFIGNITVRESNYGYLTSEKTRIQLDTRDIFEINSTAASLANYYQETYGVPESRFHLVRWASPYDTSSHLYSKTHTTGEGCTQVYESSEEIPVDRTVPVNEGYGHRLSYVTALFFQKIINTFYRNGTLPVFVWTHRSADLTNTIYPDKITQIPAVKGDQLWDGTSVVAGPGFTGGDIIRKTYGNTGYEIINVSLEVPNPNQDYFIRIRYAATNDITLSVNLFPGFLTGNFQSTMNKGEPLTYGKFKYANFQSTKFNSSKQTIRLSVSGLTVPSGTEIYIDKIEFIPVDATYEAETDLEAAKKAVKALFSNTTDTLLPGVTDYEVNQAANLVECLSDDLYPNEKRLLFDAVREAKRLSEARNLLQDPDFQEINGENGWTASTGVEIIEGDAVFKGRYLRLPGAREMDTETYPTYVYQKIEEGVLKPYTRYRLRGFVGSSQGLEIYTIRHQTNRIVKNVPDDLLPDVTSVNAGGGINRCSEQKYVNSRLEGERGLPNGNRSAEAHEFSLPINIGELDYNENAGIWVGFKITDPEGYATLGNLGLVEEGPLSGDALERLQREEQQWKLQMTKRREETDRKYTAAKQAVDRLYADYQDQQLNPNVEITDITAAQDLIQSIPYVYNEIFPEIQGMNYAKFTELSNRLQRAWGLYDQRNAIPNGDFRNGLSNWNTTPGVEVQQINDTSVLVIPNWDEQVSQQFTVQPNQRYVLRVTARKEGVGNGYVSIRDGGNQTETLTFSASDYDTNSVYNTQASNTNGLYNEQTGYITKTVTFIPYTDQVWIEMSETEGTFYIESVELIVDVE

SEQ ID NO: 473 - protein, 1169 aa, Bacillus thuringiensis kumamotoensis
MSPNNQNEYEIIDATPSTSVSNDSNRYPFANEPTNALQNMDYKDYLKMSAGNVSEYPGSPEVFLSEQDAVKAAIDIVGKLLTGLGVPFVGPIVSLYTQLIDILWPSKQKSQWEIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYMIKPAISRKTVDISSVYNQMWIEISETEGTFYIESVELIVDVE

SEQ ID NO: 474 - protein, 1206 aa, Bacillus thuringiensis
MSPNNQNEYEIIDATPSTSVSNDSNRYPFANEPTNALQNMDYKDYLKMSAGNASEYPGSPEVLVSGQDAAKAAIDIVGKLLSGLGVPFVGPIVSLYTQLIDILWPSGEKSQWEIFMEQVEELINQKIAEYARNKALSELEGLGNNYQLYLTALEEWEENPNGSRALRDVRNRFEILDSLFTQYMPSFRVTNFEVPFLTVYAMAANLHLLLLKDASIFGEEWGWSTTTINNYYDRQMKLTAEYSDHCVKWYETGLAKLKGTSAKQWVDYNQFRREMTLAVLDVVALFPNYDTRTYPMETKAQLTREVYTDPLGAVNVSSIGSWYDKAPSFGVIESSVIRPPHVFDYITGLTVYTQSRSISSARYIRHWAGHQISYHRVSRGSNLQQMYGTNQNLHSTSTFDFTNYDIYKTLSKDAVLLDIVYPGYTYIFFGMPEVEFFMVNQLNNTRKTLKYNPVSKDIIASTRDSELELPPETSDQPNYESYSHRLCHITSIPATGNTTGLVPVFSWTHRSADLNNTIYSDKITQIPAVKCWDNLPFVPVVKGPGHTGGDLLQYNRSTGSVGTLFLARYGLALEKAGKYRVRLRYATDADIVLHVNDAQIQMPKTMNPGEDLTSKTFKVADAITTLNLATDSSLALKHNLGEDPNSTLSGIVYVDRIEFIPVDETYEAEQDLEAAKKAVNALFTNTKDGLRPGVTDYEVNQAANLVECLSDDLYPNEKRLLFDAVREAKRLSEARNLLQDPDFQEINGENGWTASTGIEVIEGDALFKGRYLRLPGAREIDTETYPTYLYQKVEEGVLKPYTRYRLRGFVGSSQGLEIFTIRHQTNRIVKNVPDDLLPDVSPVNSDGSINRCSEQKYVNSRLEVENRSGEAHEFSIPIDTGEIDYNENAGIWVGFKITDPEGYATLGNLELVEEGPLSGDALERLQREEQQWKIQMTRRREETDRRYMASKQAVDRLYADYQDQQLNPDVEITDLTAAQDLIQSIPYVYNEMFPEIPGMNYTKFTELTDRLQQAWSLYDQRNAIPNGDFRNGLSNWNATPGVEVQQINHTSVLVIPNWDEQVSQQFTVQPNQRYVLRVTARKEGVGNGYVSIRDGGNQTETLTFSASDYDTNGMYNTQVSNTNGYNTNNAYNTQASSTNGYNANNMYNTQASNTNGYNTNSVYNDQTGYITKTVTFIPYTDQMWIEMSETEGTFYIESVELIVDVE

SEQ ID NO: 475 - protein, 1210 aa, Bacillus thuringiensis
MSPNNQNEYEIIDATPSTSVSNDSNRYPFANEPTNALQNMDYKDYLKMSAGNASEYPGSPEVLVSGQDAAKAAIDIVGKLLSGLGVPFVGPIVSLYTQLIDILWPSGQKSQWEIFMEQVEELINQKIAEYARNKALSELEGLGNNYQLYLTALEEWKENPNGSRALRDVRNRFEILDSLFTQYMPSFRVTNFEVPFLTVYTQAANLHLLLLKDASIFGEEWGWSTTTINNYYDRQMKLTAEYSDHCVKWYETGLAKLKGTSAKQWVDYNQFRREMTLTVLDVVALFPNYDTRTYPMETKAQLTREVYTDPLGAVNVSSIGSWYDKAPSFGVIESSVIRPPHVFDYITGLTVYTQSRSISSARYIRHWAGHQISYHRIFSDNIIKQMYGTNQNLHSTSTFDFTNYDIYKTLSKDAVLLDIVFPGYTYIFFGMPEVEFFMVNQLNNTRKTLKYNPVSKDIIAGTRDSELELPPETSDQPNYESYSHRLCHITSIPATGSTTGLVPVFSWTHRSADLINAVHSDKITQIPVVKVSDLAPSITGGPNNTVVSGPGFTGGGIIKVIRNGVIISHMRVKISDINKEYSMRIRYASANNTEFYINPSEENVKSHAQKTMNRGEALTYNKFNYATLPPIKFTTTEPFITLGAIFEAEDFLGIEAYIDRIEFIPVDETYEAEQDLEAAKKAVNALFTNTKDGLRPGVTDYEVNQAANLVECLSDDLYPNEKRLLFDAVREAKRLSEARNLLQDPDFQEINGENGWTASTGIEVIEGDALFKGRYLRLPGAREIDTETYPTYLYQKVEEGVLKPYTRYRLRGFVGSSQGLEIFTIRHQTNRIVKNVPDDLLPDVSPVNSDGSINRCSEQKYVNSRLEVENRSGEAHEFSIPIDTGEIDYNENAGIWVGFKITDPEGYATLGNLELVEEGPLSGDALERLQREEQQWKIQMTRRREETDRRYMASKQAVDRLYADYQDQQLNPDVEITDLTAAQDLIQSIPYVYNEMFPEIPGMNYTKFTELTDRLQQAWSLYDQRNAIPNGDFRNGLSNWNATPGVEVQQINHTSVLVIPNWDEQVSQQFTVQPNQRYVLRVTARKEGVGNGYVSIRDGGNQTETLTFSASDYDTNGMYNTQVSNTNGYNTNNAYNTQASSTNGYNANNMYNTQASNTNGYNTNSVYNDQTGYITKTVTFIPYTDQMWIEMSETEGTFYIESVELIVDVE

SEQ ID NO: 476 - protein, 1160 aa, Bacillus thuringiensis japonensis Buibui
MSPNNQNEYEIIDALSPTSVSDNSIRYPLANDQTNTLQNMNYKDYLKMTESTNAELSRNPGTFISAQDAVGTGIDIVSTIISGLGIPVLGEVFSILGSLIGLLWPSNNENVWQIFMNRVEELIDQKILDSVRSRAIADLANSRIAVEYYQNALEDWRKNPHSTRSAALVKERFGNAEAILRTNMGSFSQTNYETPLLPTYAQAASLHLLVMRDVQIYGKEWGYPQNDIDLFYKEQVSYTARYSDHCVQWYNAGLNKLRGTGAKQWVDYNRFRREMNVMVLDLVALFPNYDARIYPLETNAELTREIFTDPVGSYVTGQSSTLISWYDMIPAALPSFSTLENLLRKPDFFTLLQEIRMYTSFRQNGTIEYYNYWGGQRLTLSYIYGSSFNKYSGVLAGAEDIIPVGQNDIYRVVWTYIGRYTNSLLGVNPVTFYFSNNTQKTYSKPKQFAGGIKTIDSGEELTYENYQSYSHRVSYITSFEIKSTGGTVLGVVPIFGWTHSSASRNNFIYATKISQIPINKASRTSGGAVWNFQEGLYNGGPVMKLSGSGSQVINLRVATDAKGASQRYRIRIRYASDRAGKFTISSRSPENPATYSASIAYTNTMSTNASLTYSTFAYAESGPINLGISGSSRTFDISITKEAGAANLYIDRIEFIPVNTLFEAEEDLDVAKKAVNGLFTNEKDALQTSVTDYQVNQAANLIECLSDELYPNEKRMLWDAVKEAKRLVQARNLLQDTGFNRINGENGWTGSTGIEVVEGDVLFKDRSLRLTSAREIDTETYPTYLYQQIDESLLKPYTRYKLKGFIGSSQDLEIKLIRHRANQIVKNVPDNLLPDVRPVNSCGGVDRCSEQQYVDANLALENNGENGNMSSDSHAFSFHIDTGEIDLNENTGIWIVFKIPTTNGNATLGNLEFVEEGPLSGETLEWAQQQEQQWQDKMARKRAASEKTYYAAKQAIDRLFADYQDQKLNSGVEMSDLLAAQNLVQSIPYVYNDALPEIPGMNYTSFTELTNRLQQAWNLYDLQNAIPNGDFRNGLSNWNATSDVNVQQLSDTSVLVIPNWNSQVSQQFTVQPNYRYVLRVTARKEGVGDGYVIIRDGANQTETLTFNICDDDTGVLSTDQTSYITKTVEFTPSTEQVWIDMSETEGVFNIESVELVLEEE

SEQ ID NO: 477 - protein, 1160 aa, Bacillus thuringiensis HBF-1
MSPNNQNEYEIIDALSPTSVSDNSIRYPLANDQTNTLQNMNYKDYLKMTESTNAELSRNPGTFISAQDAVGTGIDIVSTIISGLGIPVLGEVFSILGSLIGLLWPSNNENVWQIFMNRVEELIDQKILDSVRSRAIADLANSRIAVEYYQNALEDWRKNPHSTRSAALVKERFGNAEAILRTNMGSFSQTNYETPLLPTYAQAASLHLLVMRDVQIYGKEWGYPQNDIDLFYKEQVSYTARYSDHCVQWYNAGLNKLRGTGAKQWVDYNRFRREMNVMVLDLVALFPNYDARIYPLETNAELTREIFTDPVGSYVTGQSSTLISWYDMIPAALPSFSTLENLLRKPDFFTLLQEIRMYTSFRQNGTIEYYNYWGGQRLTLSYIYGSSFNKYSGVLAGAEDIIPVGQNDIYRVVWTYIGRYTNSLLGVNPVTFYFSNNTQKTYSKPKQFAGGIKTIDSGEELTYENYQSYSHRVSYITSFEIKSTGGTVLGVVPIFGWTHSSASRNNFIYATKISQIPINKASRTSGGAVWNFQEGLYNGGPVMKLSGSGSQVINLRVATDAKGASQRYRIRIRYASDRAGKFTISSRSPENPATYSASIAYTNTMSTNASLTYSTFAYAESGPINLGISGSSRTFDISITKEAGAANLYIDRIEFIPVNTLFEAEEDLDVAKKAVNGLFTNEKDALQTSVTDYQVNQAANLIECLSDELYPNEKRMLWDAVKEAKRLVQARNLLQDTGFNRINGENGWTGSTGIEVVEGDVLFKDRSLRLTNAREIDTETYPTYLYQQIDESLLKPYTRYKLKGFIGSSQDLEIKLIRHRANQIVKNVPDNLLPDVRPVNSCGGVDRCSEQQYVDANLALENNGENGNMSSDSHAFSFHIDTGEIDLNENTGIWIVFKIPTTNGNATLGNLEFVEEGPLSGETLEWAQQQEQQWQDKMARKRAASEKTYYAAKQAIDRLFADYQDQKLNSGVEMSDLLAAQNLVQSIPYVYNDALPEIPGMNYTSFTELTNRLQQAWNLYDLQNAIPNGDFRNGLSNWNATSDVNVQQLSDTSVLVIPNWNSQVSQQFTVQPNYRYVLRVTARKEGVGDGYVIIRDGANQTETLTFNICDDDTGVLSTDQTSYITKTVEFTPSTEQVWIDMSETEGVFNIESVELVLEEE

SEQ ID NO: 478 - protein, 1160 aa, Bacillus thuringiensis FTL-23
MSPNNQNEYEIIDALSPTSVSDNSIRYPLANDQTNTLQNMNYKDYLKMTESTNAELSRNPGTFISAQDAVGTGIDIVSTIISGLGIPVLGEVFSILGSLIGLLWPSNNENVWQIFMNRVEELIDQKILDSVRSRAIADLANSRIAVEYYQNALEDWRKNPHSTRSAALVKERFGNAEAILRTNMGSFSQTNYETPLLPTYAQAASLHLLVMRDVQIYGKEWGYPQNDIDLFYKEQVSYTARYSDHCVQWYNAGLNKLRGTGAKQWVDYNRFRREMNVMVLDLVALFPNYDARIYPLETNAELTREIFTDPVGSYVTGQSSTLISWYDMIPAALPSFSTLENLLRKPDFFTLLQEIRMYTSFRQNGTIEYYNYWGGQRLTLSYIYGSSFNKYSGVLAGAEDIIPVGQNDIYRVVWTYIGRYTNSLLGVNPVTFYFSNNTQKTYSKPKQFAGGIKTIDSGEELTYENYQSYSHRVSYITSFEIKSTGGTVLGVVPIFGWTHSSASRNNFIYATKISQIPINKASRTSGGAVWNFQEGLYNGGPVMKLPGSGSQVINLRVATDAKGASQRYRIRIRYASDRAGKFTISSRSPENPATYSASIAYTNTMSTNASLTYSTFAYAESGPINLGISGSSRTFDISITKEAGAANLYIDRIEFIPVNTLFEAEEDLDVAKKAVNGLFTNEKDALQTSVTDYQVNQAANLIECLSDELYPNEKRMLWDAVKEAKRLVQARNLLQDTGFNRINGENGWTGSTGIEVVEGDVLFKDRSLRLTSAREIDTETYPTYLYQQIDESLLKPYTRYKLKGFIGSSQDLEIKLIRHRANQVVKNVPDNLLPDVRPVNSCGGVDRCSEQQYVDANLALENNGENGNMSFDSHAFSFHIDTGEIDLNENTGIWIVFKIPTTNGNATLGNLEFVEEGPLSGETLEWAQQQEQQWQDKMARKRAASEKTYYAAKQAIDRLFADYQDQKLNSGVEMSDLLAAQNLVQSIPYVYNDALPEIPGMNYTSFTELTNRLQQAWNLYDLQNAIPNGDFRNGLSNWNATSDVNVQQLSDTSVLVIPNWNSQVSQQFTVQPNYRYVLRVTARKEGVGDGYVIIRDGANQTETLTFNICDDDTGVLSTDQTSYITKTVEFTPSTEQVWIDMSETEGVFNIESVELVLEEE

SEQ ID NO: 479 - protein, 1160 aa, Bacillus thuringiensis S185
MSPNNQNEYEIIDALSPTSVSDNSIRYPLANDQTNTLQNMNYKDYLKMTESTNAELSRNPGTFISAQDAVGTGIDIVSTIISGLGIPVLGEVFSILGSLIGLLWPSNNENVWQIFMNRVEELIDQKILDSVRSRAIADLANSRIAVEYYQNALEDWRKNPHSTRSAALVKERFGNAEAILRTNMGSFSQTNYETPLLPTYAQAASLHLLVMRDVQIYGKEWGYPQNDIDLFYKEQVSYTARYSDHCVQWYNAGLNKLRGTGAKQWVDYNRFRREMNVMVLDLVALFPNYDARIYPLETNAELTREIFTDPVGSYVTGQSSTLISWYDMIPAALPSFSTLENLLRKPDFFTLLQEIRMYTSFRQNGTIEYYNYWGGQRLTLSYIYGSSFNKYSGVLAGAEDIIPVGQNDIYRVVWTYIGRYTNSLLGVNPVTFYFSNNTQKTYSKPKQFAGGIKTIDSGEELTYENYQSYSHRVSYITSFEIKSTGGTVLGVVPIFGWTHSSASRNNFIYATKISQIPINKASRTSGGAVWNFQEGLYNGGPVMKLSGSGSQVINLRVATDAKGASQRYRIRIRYASDRAGKFTISSRSPENPATYSASIAYTNTMSTNASLTYSTFAYAESGPINLGISGSSRTFDISITKEAGAANLYIDRIEFIPVNTLFEAEEDLDVAKKAVNGLFTNEKDALQTSVTDYQVNQAANLIECLSDELYPNEKRMLWDAVKEAKRLVQARNLLQDTGFNRINGENGWTGSTGIEVVEGDVLFKDRSLRLTSAREIDTETYPTYLYQQIDESLLKPYTRYKLKGFIGSSQDLEIKLIRHRANQIVKNVPDNLLPDVRPVNSCGGVDRCSEQQYVDANLALENNGENGNMSSDSHAFSFHIDTGEIDLNENTGIWIVFKISTTNGNATLGNLEFVEEGPLSGETLEWAQQQEQQWQDKMARKRAASEKTYYAAKQAIDRLFADYQDQKLNSGVEMSDLLAAQNLVQSIPYVYNDALPEIPGMNYTSFTELTNRLQQAWNLYDLQNAIPNGDFRNGLSNWNATSDVNVQQLSDTSVLVIPNWNSQVSQQFTVQPNYRYVLRVTARKEGVGDGYVIIRDGANQTETLTFNICDDDTGVLSTDQTSYITKTVEFTPSTEQVWIDMSETEGVFNIESVELVLEEE

SEQ ID NO: 480 - protein, 1144 aa, Bacillus thuringiensis galleriae
MSPNNQNEYEILDASSSTSVSDNSVRYPLANDQTTTLQNMNYKDYLRMSEGENPELFGNPETFISSSTVQTGIGIVGQVLGALGVPFAGQIASFYSFIVGQLWPSSTVSVWEMIMKQVEDLIDQKITDSVRKTALAGLQGLGDGLDVYQKSLKNWLENRNDTRARSVVVTQYIALELDFVAKIPSFAISGQEVPLLSVYAQAANLHLLLLRDASIFGAEWGFTPGEISTFYDRQVTRTAQYSDYCVKWYNTGLDKLKGTNAASWLKYHQFRREMTLLVLDLVALFPNYDTRTYPIETTAQLTREVYTDPIVFNRETSGGFCRRWSLNSDISFSEVESAVIRSPHLFDILSEIEFYTTRAGLPLNNTEYLEYWVGHSIKYKNTNASSALERNYGTITSNKIKYYDLANKDIFQVRSLGADLANYYAQVYGVPYASFTLLDKNTGSGSVGGFTYSKPHTTMQVCTQNYNTIDEIPPENEPLSRGYSHRLSHITSYSFSKNASSPARYGNLPVFAWTHRSADVTNTVYSDKITQIPVVKAHTLVSGTTVIKGPGFTGGNILKRTSSGPLAYTSVSVKSPLSQRYRARIRYASTTNLRLFVTISGTRIYSINVNKTMNKGDDLTFNTFDLATIGTAFTFSNYSDSLTVGADSFASGGEVYVDKFELIPVNATFEAEEDLDVAKKAVKNLVECLSDELYPNEKRMLWDAVKEAKRLVQARNLLQDTGFNRINGENGWTGSTGIEVAEGDVLFKDRSLRLTSAREIDTETYPTYLYQQIDESLLKPYTRYKLKGFIGSSQDLEIKLIRHRANQIVKNVPDNLLPDVLPVNSCGGIDRCSEQQYVDANLALENNGENGNMSSDSHAFSFHIDTGEIDLNENTGIWVVFKIPTTNGYATLGNLELVEEGPLSGETLERAQQQEQQWQDKMARKRGASEKAYYAAKQAIDRLFADYQDQKLNSGVEMSDMLAAQNLVQSIPYVYNDALPEIPGMNYTSFTELTNRLQQAWNLYDLRNAIPNGDFRNGLSDWNATSDVNVQQLSDTSVLVIPNWNSQVSQQFTVQPNYRYVLRVTARKEGVGDGYVIIRDGANQTETLTFNICDDDTGVLSADQTSYITKTVEFTPSTEQVWIDMSETEGVFNIESVELVLEEE

SEQ ID NO: 481 - protein, 1167 aa, Bacillus thuringiensis
MSPNNQNEYEILDASSSTSVSDNSVRYPLANDQTTTLQNMNYKDYLRMSEGENPELFGNPETFISSSTVQTGIGIVGQVLGALGVPFAGQIASFYSFIVGQLWPSSTVSVWEMIMKQVEDLIDQKITDSVRKTALAGLQGLGDGLDVYQKSLKNWLENRNDTRARSVVVTQYIALELDFVAKIPSFAISGQEVPLLSVYAQAANLHLLLLRDASIFGAEWGFTPGEISTFYDRQVTRTAQYSDYCVKWYNTGLDKLKGTNAASWLKYHQFRREMTLLVLDLVALFPNYDTRTYPIETTAQLTREVYTDPIVFNRETSGGFCRRWSLNSDISFSEVESAVIRSPHLFDILSEIEFYTTRAGLPLNNTEYLEYWVGHSIKYKNTNASSALERNYGTITSNKIKYYDLANKDIFQVRSLGADLANYYAQVYGVPYASFTLLDKNTGSGSVGGFTYSKPHTTMQVCTQNYNTIDEIPPENEPLSRGYSHRLSHITSYSFSKNASSPARYGNLPVFAWTHRSADVTNTVYSDKITQIPVVKAHTLVSGTTVIKGPGFTGGNILKRTSSGPLAYTSVSVKSPLSQRYRARIRYASTTNLRLFVTISGTRIYSINVNKTMNKGDDLTFNTFDLATIGTAFTFSNYSDSLTVGADSFASGGEVYVDKFELIPVNATFEAEEDLDVAKKAVNGLFTSKKDALQTSVTDYQVNQAANLVECLSDELYPNEKRMLWDAVKEAKRLVQARNLLQDTGFNRINGENGWTGSTGIEVAEGDVLFKDRSLRLTSAREIDTETYPTYLYQQIDESLLKPYTRYKLKGFIGSSQDLEIKLIRHRANQIVKNVPDNLLPDVLPVNSCGGIDRCSEQQYVDANLALENNGENGNMSSDSHAFSFHIDTGEIDLNENTGIWVVFKIPTTNGYATLGNLELVEEGPLSGETLERAQQQEQQWQDKMARKRGASEKAYYAAKQAIDRLFADYQDQKLNSGVEMSDMLAAQNLVQSIPYVYNDALPEIPGMNYTSFTELTNRLQQAWNLYDLRNAIPNGDFRNGLSDWNATSDVNVQQLSDTSVLVIPNWNSQVSQQFTVQPNYRYVLRVTARKEGVGDGYVIIRDGANQTETLTFNICDDDTGVLSADQTSYITKTVEFTPSTEQVWIDMSETEGVFNIESVELVLEEE

SEQ ID NO: 482 - protein, 1174 aa, Bacillus thuringiensis BBT2-5
MSPNNQNEYEILDASSSTSVSDSSVRYPLANDQTTTLQNMNYKDCLRMSEGENPELFGNPETFISSSTVQTGIGIVGQVLGALGVPFAGQIASFYSFIVGQLWPSSTVSVWEMIMKQVEDLIDQKITDSVRKTALAGLQGLGDGLDVYQKSLKNWLENRNDTRARSVVVTQYIALELDFVAKIPSFAISGQEVPLLSVYAQAANLHLLLLRDASIFGAEWGFTPGEISTFYDRQVTRTAQYSDYCVKWYNTGLDKLKGTNAASWLKYHQFRREMTLLVLDLVALFPNYDTRTYPIETTAQLTREVYTDPIVFNRETSGGFCRRWSLNSDISFSEVESAVIRSPHLFDILSEIEFYTTRAGLPLNNTEYLEYWVGHSIKYKNTNASSALERNYGTITSNKIKYYDLANKDIFQVRSLGADLANYYAQVYGVPYASFTLLDKNTGSGSVGGFTYSKPHTTMQVCTQNYNTIDEIPPENEPLSRGYSHRLSHITSYSFSKIASSPARYGNLPVFAWTHRSADVTNTVYSDKITQIPVVKGIDLGSTSTIVNFEYNGGSIVKDTKSSTHNNSLSRIVSLMIKTEDPNPNSRSLYRIRVKYAADVPGTFRLHIQNTSPVTVPFTATMSGTNLQYSSFKYIEYIGYFNNREVGFSIESSTSQGRTRNVYIDKIEFIPVDATYIAEEDLEVAKKAVNGLFTNTKDALQTSVTDYQVNQAANLVECLSDELYPNEKRMLWDAVKEAKRLVQARNLLQDTGFNRINRENGWTGSTGIEIVEGDVLFKDRSLRLTSAREIDTETYPTYLYQQIDESLLKPYTRYKLKGFIGSSQDLEIKLIRHRANQIVKNVPDNLLPDVLPVNSCGGIDRCSEQQYVDANLALENNGENGNMSSDSHAFSFHIDTGEIDLNENTGIWVVFKIPTTNGYATLGNFELVEEGPLSGETLERAQQQEQQWQDKMARKRGASEKAYYAAKQAIDRLFADYQDQKLNSGVEMSDMLAAQNLVQSIPYVYNDALPEIPGMNYTSFTELTNRLQQAWNLYDLRNAIPNGDFRNGLSDWNATSDVNVQQLSDTSVLVIPNWNSQVSQQFTVQPNYRYVLRVTARKEGVGDGYVIIRDGANQTETLTFNICDDDTGVLSADQTSYITKTVEFTPSTEQVWIDMSETEGVFNIESVELVLEEE

SEQ ID NO: 483 - protein, 1164 aa, Bacillus thuringiensis 185
MSPNNQNEYEIIDMAPSTSVSNDSNRYPFASDPTNALQNMNYKEYLRMSEGYDSEYSGSPEVLISERDAVKTAISLVGTILGKLGVPLVGPIVSLYSTLIDVLWPGGKSQWEIFMEQVEALINQKIAEYARAKALAELEGLGNNYQLYLTALEEWQENPSSTRVLRDVRNRFEILDSLFTQYMPSFRVTGYEVPLLSVYAQAANLHLLLLKDASIFGEEWGFSTTAINNYYNRQMSLIAQYSDHCVQWYRTGLDRLKGSNAKQWVEYNRFRREMTLSVLDIMTLFPMYDMRTYPMETKAQLTREVYTDPIGAIGAQGSWYDSAPSFNTLESTFIRGKHLFDFITRLSIYTGRSSFSASNYLKKWIGHQISSQPIGGSIQTQTYGTTSGSSVIATQQIGFTGFDVYKTLSTAGVLFAYTSKYYGVSKVVFDAIYPDNKYKTTFTYNPGSEGIGAQEKDSEVELPPETLDQPNYEAYSHRLNYVTFIRNPDVPVFSWTHRSADRTNTVYSDKITQIPVVKASDGPKPSANEVGHYLGGDPISFNSSGSTGVIRLNINSPLSQKYRVRIRYCSSVDFDLDVVRGGTTVNNGRFNKSAPNVGWQSLKYENFKFASFSTPFTFNQAQDTLKISVRNFSSIVGGSVVYIDRIELIPVNATYEAEQDLDSAKKAVNTLFTNTKDGLRPGVTDYEVNQAANLVECLSDDLYPNEKRLLFDAVKEAKRLSEARNLLQDPDFQEINGENGWTASTGIEVVEGDALFKGRYLRLPGAREMDTETYPTYLYQKVEEGVLKPYTRYRLRGFVGSSQGLEISTIRHQTNRIVKNVPDDLLPDVPPVNSDGRINRCSEQKYVNSRLEGERGLPNGNRSAEAHEFSLPIDIGELDYNENAGIWVGFKITDPEGYATLGNLELVEEGPLSGDALERLQREEQQWKLQMTKRREETDRKYTAAKQAVDRLYADYQDQQLNPNVEITDITAAQNLIQSIPYVYNEMFPEIQGMNYTKYTELTNRLQQAWGLYDQRNAIPNGDFRNELSNWNTTSGVNVQQINNTSVLVMPNWDGQVSQQFTVQPNQRYVLRVTARKEGVGNGYVSIRDGGNQTETLTFSASDYNTDSVYNTQVSNTNGLYNEQTGYTTKTVTFIPYTDQVWIEMSETEGMFYIESVELIVDVE

SEQ ID NO: 484 - protein, 1164 aa, Bacillus thuringiensis B-DLL
MSPNNQNEYEIIDMAPSTSVSNDSNRYPFASDPTNALQNMNYKEYLRMSEGYDSEYSGSPEVLISERDAVKTAISLVGTILGKLGVPLVGPIVSLYSTLIDVLWPGGKSQWEIFMEQVEALINQKIAEYARAKALAELEGLGNNYQLYLTALEEWQENPSSTRVLRDVRNRFEILDSLFTQYMPSFRVTGYEVPLLSVYAQAANLHLLLLKDASIFGEEWGFSTTAINNYYNRQMSLIAQYSDHCVQWYRTGLDRLKGSNAKQWVEYNRFRREMTLSVLDIMTLFPMYDMRTYPMETKAQLTREVYTDPIGAIGAQGSWYDSAPSFNTLESTFIRGKHLFDFITRLSIYTGRSSFSASNYLKKWIGHQISSQPIGGSIQTQTYGTTSGSSVIATQQIGFTGFDVYKTLSTAGVLFAYTSKYYGVSKVVFDAIYPDNKYKTTFTYNPGSEGIAAQEKDSEVELPPETLDQPNYEAYSHRLNYVTFIRNPDVPVFSWTHRSADRTNTVYSDKITQIPVVKASDGPKPFVNEVGHYLGGEPISFISSGSTGVIRLNINSPLSQKYRVRIRYCSSVDFDLDVVRGGTTVNNGRFNKSAPNVGWQSLKYENFKFASFSTPFTFNQAQDTLKISVRNFSSIVGGSVVYIDRIELIPVNATYEAEQDLDSAKKAVNTLFTNTKDGLRPGVTDYEVNQAANLVECLSDDLYPNEKRLLFDAVKEAKRLSEARNLLQDPDFQEINGENGWTASTGIEVVERDALFKGRYLRLPGAREMDTETYPTYLYQKVEEGVLKPYTRYRLRGFVGSSQGLEISTIRHQTNRIVKNVPDDLLPDVPPVNSDGRINRCSEQKYVNSRLEGERGLPNGNRSAEAHEFSLPIDIGELDYNENAGIWVGFKITDPEGYATLGNLELIEEGPLSGDALERLQREEQQWKLQMTKRREETDRKYTAAKQAVDRLYADYQDQQLNPNVEITDITAAQHLIQSIPYVYNEMFPEIQGMNYTKYTELTNRLQQAWGLYDQRNAIPNGDFRNELSNWNTTSGVNVQQINNTSVLVMPNWDGQVSQQFTVQPNQRYVLRVTARKEGVGNGYVSIRDGGNQTETLTFSASDYNTDSVYNTQVSNTNGLYNEQTGYTTKTVTFIPYTDQVWIEMSETEGMFYIESVELIVDVE

SEQ ID NO: 485 - protein, 1174 aa, Bacillus thuringiensis 185
MSPNNQNEYEIIDMAPSTSVTNDSNRYPFANEPTNALQNMNYKDYLRMSEGYSPEYLTSLSPYSQFGTVDKIISIISLLNSAAGIPGLDFFTGLLQFILDFFAPEDPWAELMELVEQLIDQKITVATREKALAELRGLINGYLVYQQSLESWLENPNATRASIVREQYVALELDFVTSISSFAIAGQEVPLLAVYAQAANLHLLLLRDVSIFGEEWGLTVNEVNTFYIRQMTYTTEYSDYCVRIYNTGLNKLKGSSASSWVDYNRFRREMNLLVLDIIALFPNYDVRRYPMETTTELTRVVYTDPIVFDERKGVASTHSWTAIAPSFSSIESLTRRPGLFTWLDQLTIFSKRISQPSVFINSWAGHKISTFRTQKTDILINTTHGDTNNPIKEFVVDTKKVEDIYQTIAYPHAVANEVFYLFGVPKVDFNMVPAGGSANSAHTLIFSDSTGGRLESITKNSEAELPPTESLSDTPQPNQVTYSHRLDYATIIKANKSYGSGYIPLLGWTHRSVDRNNTIYPNKITQIPAVKAFSYTESFNVNVIAGPGFTGGDLISLGHLENIYMKLNVPNPQKFRVRIRYAASTTSYLQITGLSNLAQSDRFEQTYSNENENNLMFENFQYVELRNIFSVDAPLENHQVSIQNYQGNGFVIIDRIEFIPVNATYEAEQDLDSAKKAVNTLFTNTKDGLRPGVTDYEVNQAANLVECLSDDLYPNEKRLLFDAVKEAKRLSEARNLLQDPDFQEINGENGWTASTGIEVVEGDALFKGRYLRLPGAREMDTETYPTYLYQKVEEGVLKPYTRYRLRGFVGSSQGLEISTIRHQTNRIVKNVPDDLLPDVPPVNSDGRINRCSEQKYVNSRLEGERGLPNGNRSAEAHEFSLPIDIGELDYNENAGIWVGFKITDPEGYATLGNLELVEEGPLSGDALERLQREEQQWKLQMTKRREETDRKYTAAKQAVDRLYADYQDQQLNPNVEITDITAAQNLIQSIPYVYNEMFPEIQGMNYTKYTELTNRLQQAWGLYDQRNAIPNGDFRNELSNWNTTSGVNVQQINNTSVLVMPNWDGQVSQQFTVQPNQRYVLRVTARKEGVGNGYVSIRDGGNQTETLTFSASDYNTDSVYNTQVSNTNGLYNEQTGYTTKTVTFIPYTDQVWIEMSETEGMFYIESVELIVDVE

SEQ ID NO: 486 - protein, 1174 aa, Bacillus thuringiensis DLL
MSPNNQNEYEIIDMAPSTSVTNDSNRYPFANEPTNALQNMNYKDYLRMSEGYSPEYLTSLSPYSQFGTVDKIISIISLLNSAAGIPGLDFFTGLLQFILDFFAPEDPWAELMELVEQLIDQKITVATREKALAELRGLINGYLVYQQSLESWLENPNATRASIVREQYVALELDFVTSISSFAIAGQEVPLLAVYAQAANLHLLLLRDVSIFGEEWGLTVNEVNTFYIRQMTYTTEYSDYCVRIYNTGLNKLKGSSASSWVDYNRFRREMNLLVLDIIALFPNYDVRRYPMETTTELTRVVYTDPIVFDERKGVASTHSWTAIAPSFSSIESLTRRPGLFTWLDQLTIFSKRISQPSVFINSWAGHKISTFRTQKTDILINTTHGDTNNPIKEFVVDTKKVEDIYQTIAYPHAVANEVFYLFGVPKVDFNMVPAGGSANSAHTLIFSNSTGGRLESITKNSEAELPPTESLSDTPQPNQVTYSHRLDYATIIKANKSYGSGYIPLLGWTHRSVDRNNTIYPNKITQIPAVKAFSYTESFNVNVIAGPGFTGGDLISLGHLENIYMKLNVPNPQKFRVRIRYAASTTSYLQITGLSNLAQSDRFEQTYSNENENNLMFENFQYVELRNIFSVDAPLENHQVSIQNYQGNGFVIIDRIEFIPVNATYEAEQDLDSAKKAVNTLFTNTKDGLRPGVTDYEVNQAANLVECLSDDLYPNEKRLLFDAVKEAKRLSEARNLLQDPDFQEINGENGWTASTGIEVVEGDALFKGRYLRLPGAREMDTETYPTYLYQKVEEGVLKPYTRYRLRGFVGGSQGLEISTIRHQTNRIVKNVPDDLLPDVPPVNSDGRINRCSEQKYVNSRLEGERGLPNGNRSAEAHEFSLPIDIGELDYNENAGIWVGFKITDPEGYATLGNLELVEEGPLSGDALERLQREEQQWKLQMTKRREETDRKYTAAKQAVDRLYADYQDQQLNPNVEITDITAAQNLIQSIPYVYNEMFPEIQGMNYTKYTELTNRLQQAWGLYDQRNAIPNGDFRNELSNWNTTSGVNVQQINNTSVLVMPNWDGQVSQQFTVQPNQRYVLRVTARKEGVGNGYVSIRDGGNQTETLTFSASDYNTDSVYNTQVSNTNGLYNEQTGYTTKTVTFIPYTDQVWIEMSETEGMFYIESVELIVDVE

SEQ ID NO: 487 - protein, 1174 aa, Bacillus thuringiensis L-27
MSPNNQNEYEIIAYGTSTSVTNDSNRYPFANEPTNALQNMNYKDYLRMSEGYSPEYLTSLSPYSQFGTVDKIISIISLLNSAAGIPGLDFFTGLLQFILDFFAPEDPWAELMELVEQLIDQKITVATREKALAELRGLINGYLVYQQSLESWLENPNATRASIVREQYVALELDFVTSISSFAIAGQEVPLLAVYAQAANLHLLLLRDVSIFGEEWGLTVNEVNTFYIRQMTYTTEYSDYCVRIYNTGLNKLKGSSASSWVDYNRFRREMNLLVLDIIALFPNYDVRRYPMETTTELTRVVYTDPIVFDERKGVASTHSWTAIAPSFSSIESLTRRPGLFTWLDQLTIFSKRISQPSVFINSWAGHKISTFSTQKTDILINTTHGDTNNPIKEFVVDTKKVEDIYQTIAYPHAVANEVFYLFGVPKVDFNMVPAGGSANSAHTLIFSDSTGGRLESITKNSEAELPPTESLSDTPQPNQVTYSHRLDYATIIKANKSYGSGYIPLLGWTHRSVDRNNTIYPNKITQIPAVKAFSYTESFNVNVIAGPGFTGGDLISLGHLENIYMKLNVPNPQKFRVRIRYAASTTSYLQITGLSNLAQSDRFEQTYSNENENNLMFENFQYVELRNIFSVDAPLENHQVSIQNYQGNGFVIIDRIEFIPVNATYEAEQDLDSAKKAVNTLFTNTKDGLRPGVTDYEVNQAANLVECLSDDLYPNEKRLLFDAVKEAKRLSEARNLLQDPDFQEINGENGWTASTGIEVVEGDALFKGRYLRLPGAREMDTETYPTYLYQKVEEGVLKPYTRYRLRGFVGSSQGLEISTIRHQTNRIVKNVPDDLLPDVPPVNSDGRINRCSEQKYVNSRLEGERGLPNGNRSAEAHEFSLPIDIGELDYNENAGIWVGFKITDPEGYATLGNLELVEEGPLSGDALERLQREEQQWKLQMTKRREETDRKYTAAKQAVDRLYADYQDQQLNPNVEITDITAAQNLIQSIPYVYNEMFPEIQGMNYTKYTELTNRLQQAWGLYDQRNAIPNGDFRNELSNWNTTSGVNVQQINNTSVLVMPNWDGQVSQQFTVQPNQRYVLRVTARKEGVGNGYVSIRDGGNQTETLTFSASDYNTDSVYNTQVSNTNGLYNEQTGYTTKTVTFIPYTDQVWIEMSETEGMFYIESVELIVDVE

SEQ ID NO: 488 - protein, 1157 aa, Bacillus thuringiensis HBF-18
MSPNNQNEYEIIDASSPTSVSNNSVKYPLASDQTTTLQNMNYKDYLRMSEGENPELFGNPETFISAQDAVGTGIDIVSKLLGSLGVPLVGQAATALKWIIGKLWPSSGNPWDDLMTAVEELINQKIEAYARSKALAELGVSGRAVKSYQTALEEWQKNPNNARSAALVRERFSDAEHTLRTQMSLFTVRGYEIPLLATYAQAANLHLFVMKDIQIYGREWGYTQGDINLFYREQVEFTGEYSDYCVKWYNAGLDKLRGSTALQWINYNRFRREMTVMALDIVALFPNYDIRMYPMKTTAELTRRIYTDPLGYTGSGSNTPPWYNYGYSFSWIENNAVPAPGLFQWLQGIGIYTKFARITPFYANYWSGHTVFYKFTNDSTERRVQYGDTDTPELDSSSFENVDIYKVSASVGSYKSNTVLLPTFKATFEGVNQNNQLKTFRYQKESNVPSQTKNSTTELPVQLSTPPTYGDSEQYSHRLAYVFDAPIDSYTGIYRMYGFAPILGWTHISVSRDNRIDPDKITQIPAVKAYAEGLANYIKDPGFTGGDLLALGRNSNTSLIVNFSKPQTYRIRIRYAASKTSYFQLRGLHNIAQSQRFEATYSNKNENDLTFNDFKYVEIQKTVSIDNPSESRSISIYTQSDTELLIIDKIEFIPVDATFEAEQDLDVAKKAVNGLFTNTKDALQTSVTGYQGNQAGKLSRMPIDELYPNEKRMLWDAVKEAKRLVQARNLLQDTGFNVINGENGWTGSTGIEVVEGDVLFKDRSLRLPSAREIDTETYPTYLYQQIDESLLKPYTRYRLRGFIGSSQDLEIKLIRHRANQIVKNVPDNLLPDVRPVNSCGGVDRCSEQQYVDANLALENNGENRNMSSDSHAFSFHMDTGEIDLNENTGIWVVFKIPTTNGYATLGNLELVEEGPLSGDALERLQREEQQWKLQRTKRREETDRKYMAAKQAIDRLFADYQDQQLNSGVEMSDLLAAQNLVQSIPYVYNEMFPEIPGMNYTNFTELTNRLQQAWNLYDLRNAIPNGDFRNGLSDWNATSDINVQQLNDTSVLVIPNWNSQVSQQFTVQPNYRYVLRVTARKEGAGDGYVIIRDGTNQTETLAFNTCDNDAGVLSTNQASYITKTVEFTPSTEQVWIDMSETEGVFNIESVELVLEEE

SEQ ID NO: 489 - protein, 1157 aa, Bacillus thuringiensis 145
MSPNNQNEYEIIDASSPTSVSNNSVKYPLASDQTTTLQNMNYKDYLRMSEGENPELFGNPETFISAQDAVGTGIDIVSKLLGSLGVPLVGQAATALKWIIGKLWPSSGNPWDDLMTAVEELINQKIEAYARSKALAELGVSGRAVKSYQTALEEWQKNPNNARSAALVRERFSDAEHTLRTQMSLFTVRGYEIPLLATYAQAANLHLFVMKDIQIYGREWGYTQGDINLFYREQVEFTGEYSDYCVKWYNAGLDKLRGSTALQWINYNRFRREMTVMALDIVALFPNYDIRMYPMKTTAELTRRIYTDPLGYTGSGSNTPPWYNYGYSFSWIENNAMPAPGLFQWLQGIGIYTKFARITPFYANYWSGHTVFYKFTNDSTERRVQYGDTDTPELDSSSFENVDIYKVSASVGSYKSNTVLLPTFKATFEGVNQNNQLKTFRYQKESNVPSQTKNSTTELPVQLSTPPTYGDSEQYSHRLAYVFDAPIDSYTGIYRMYGFAPILGWTHISVSRDNRIDPDKITQIPAVKAYAEGLANYIKDPGFTGGDLLALGRNSNTSLIVNFSKPQTYRIRIRYAASKTSYFQLRGLHNIAQSQRFEATYSNKNENDLTFNDFKYVEIQKTVSIDNPSESRSISIYTQSDTELLIIDKIEFIPVDATFEAEQDLDVAKKAVNGLFTNTKDALQTSVTDYQVNQAANLVECLSDELYPNEKRMLWDAVKEAKRLVQARNLLQDTGFNVINGENGWTGSTGIEVVEGDVLFKDRSLRLPSAREIDTETYPTYLYQQIDESLLKPYTRYRLRGFIGSSQDLEIKLIRHRANQIVKNVPDNLLPDVRPVNSCGGVDRCSEQQYVDANLALENNGENRNMSSDSHAFSFHMDTGEIDLNENTGIWVVFKIPTTNGYATLGNLELVEEGPLSGDALERLQREEQQWKLQRTKRREETDRKYMAAKQAIDRLFADYQDQQLNSGVEMSDLLAAQNLVQSIPYVYNEMFPEIPGMNYTNFTELTNRLQQAWNLYDLRNAIPNGDFRNGLSDWNATSDINVQQLNDTSVLVIPNWNSQVSQQFTVQPNYRYVLRVTARKEGAGDGYVIIRDGTNQTETLAFNTCDNDAGVLSTNQASYITKTVEFTPSTEQVWIDMSETEGVFNIESVELVLEEE

SEQ ID NO: 490 - protein, 1157 aa, Bacillus thuringiensis FCD114; identical to SEQ ID NO: 489

SEQ ID NO: 491 - protein, 1199 aa, Bacillus thuringiensis 185
MSPNNQNEYEIIDTPSRTSVSNDSVRYPFASDPTTDLNNMNYKDFLKTVNGYNTGDLSGSEAFISQTAINTAGKAVGTVLGLLGVPLAGAVGPLISFYGAVALLFWGPGDPWQAFMTQVEALVNQKIADYARNKAIAELQGLRNILDLYRLALIEWEENPTRTRSLTNIRLKFEDVNQFFEYQMPSFAVGGYEVPLLAVYAQAANLHLSVLRDAAIFGEQWGMSQTAINNIYDLQQRRTAEYINHCVKWYNNGLDKLRGSNAGQWVNFNRYRREMTLMVLDIVAIFPNYDTRTYPSGIGTSVQLTREVYTDPIGATSTQGGVSWYDDAPSFTAIESSVVRPLHLFDLLTGVTVYAASSSWDSSHYFRFWNGHKVDTKGIKSSVQYSNVYGSTSNAVSTTIIPFSGFDVYRVFSLAGVLFAWTTRYFGAPEVYFQRVDHNSGIDVGYDIAFSERYAGIGEQQKDSLDELPLQTEGPAYRSYSHRLNHISMVPQTVRTRNVPVFSWSHRSADIDNRIFQDRINQIPVVKGHTLGPGASVMAGPGFTGGNIVTRTSPGVVVFSGVTIKNALSQRYRVRIRYASTTDFRFFSTLSGTRLYATQATKTMNKGQQLTYESFQYATIGSTFTFENVNDSLTIGADQFLSGEQVYVDRYEVIPVDATFEAENDLEVAKKAVNNLFTNAKDALQTDVTDYQVNQAANLVECLSSELYPNEKRLLFDAVKEAKRLDQARNLLQDTQFNEMNGENGWNGSTGVEIVEDDVFFKDRSIRLSSAREAGTENSPTYLYQKIDESRLKPYTRYSLRGFVRSSQNLEIYVTRYQTQRVVKNIVDNFLPDMYAVNACGGIDRCGEQKHVNTMLGLENNVPNGNTVSDSHEFSIPVDTGELNYNEDTGIWVVFKITTTDGYATLGNLELVEEGPLSGETLERVKNQGKQWQDQMARRRAETDTRYGTAKQAIDRLFVDYQDQQLSPSIEISDLTAAQNLVQSIPYVYNDTLPEIPGMNYTSVTELTNRLQQAWNLYDLRNSIQNGDFRNDVSNWNVTPGVNIQQMNHTSVLVIPNWDSQASQQITVQPNRRYVLRVTARKEGSGDGYVTIRDGAKYTETLTFNTCDYNGSSVYQEQALYTNDVYNTQSVNIQGSNSAYHTQATNTDRYNMNGMYNDQTSYVTKTVEFIPYTEQVWIEMSETEGVFYIESVELIVEEM

SEQ ID NO: 492 - protein, 1194 aa, Bacillus thuringiensis su4
MSPNNQNEFDIIDVPSNISVSNSFVRYPFANDPNRTLQNTNYKDFLTMSEKSNSGYLTDPEAFDDVGSAIFAGLSITAKIMDAFDVPGGDIFNGLLEIIGILWDLQDDTWEAFMEQVEVLIDQKIAEYARNLALTNLKGLENSYKLYLEALADWKQNPTSPSSQERVRTRFRDTDDSLTVFMPSFAVKGYEVPLLAVYAQAANLHLLLLRDSVAYGLGWGLSQLNVNDNYNRQVRLTGEYTNHCVSWYTTGLEKLRGSNAQSWIKFNRYRREMTVMVLDIVALFPNYDARRYPQATTTELTRLIYTDPHGYTIYSPTSQTTIPWYEYGQSFSEIENVAIQAPRLFRWAQEMQIYTKFVRHAPQESHYWSAHTFSFHHTRDNTKTTLTYGDTSDPISVGTADLSDLDIYKVSSLVASSWGSGVRLLVTKAKFEVIYTFNQLWEFNYEPPGISNFFNQWKNTDTELPIQIVDPPTFGDPNQYSHRVAYISHAPIQPYSGAFRNYGLVPVFGWSHVSVDRNNTLYADRITQIPAVKAVQLSGEPYPVVRGPGFTGGDIARLPNNPNVGLLFNSKVESPSENKRYRVRIRYACASGARAIFGGLYLPITVQFNQTMSTTTPTRYEDFQYVDVSGSFILGNTNVSFSLVPQSANQTNNLFIDKIEFIPENPALEAESDLEAAKKAVNALFTNSKDTLQIGVTDYQINQAANLIECVSDEVYPNEKRLLFDAVKEAKRLSTARNLLEDTDFHTINGGNGWTGSTGIEIVEGDILFKDRSLRLPSAREIERETYPTYIYQKIEESRLKPNTRYSLRGFIGSSQDLEIYVLRHQAYRVIKNVSDNLLPNMRPINACGGVDRCSQQKYVNNSLEVNSGLSNGIGAADSHEFSIHVDTGELNYNEDMGIGVVFKITTTDGYATVGNIELVEVETLSGEALERVQRQEKQWQGQLATRRKETETRYGPAKQAIDRLFVDFQDQQLSRSTEISDLTEAQNLVQSIPYVYNDMLPEIPGMNYTSVTELTNRLQQAWNLYDQRNSIQNGDFRNDVSNWNVTTEVNIQQMNDTSVLVIPNWDSQVSQQITVQPNRRYVLRVTARKEGNGDGYVTIRDGANHTETLTFNTCDYDGNSVYNNQPLNANNNVYTTKSSNTNSYHTNGVYHDQTSYVTKTMEFTPYTEQVWVEMSETEGVFYIDSVELIVEEM

SEQ ID NO: 493 - protein, 1162 aa, Bacillus thuringiensis FPT-2
MSPNNQNEYEIIDMAPSTSVSNDSNRYPFASDPTNALQNMNYKEYLRMSEGYDSEYSGSPEVLISERDAVKTAISLVGTILGKLGVPLVGPIVSLYSTLIDVLWPGGKSQWEIFMEQVEALINQKIAEYARAKALAELEGLGNNYQLYLTALEEWQENPSSTRVLRDVRNRFEILDSLFTQYMPSFRVTGYEVPLLSVYAQAANLHLLLLKDASIFGEEWGFSTTAINNYYNRQMSLIAQYSDHCVQWYRTGLDRLKGSNAKQWVEYNRFRREMTLSVLDIMTLFPMYDMRTYPMETKAQLTREVYTDPIGAIGAQGSWYDSAPSFNTLESTFIRGKHLFDFITRLSIYTGRSSFSASNYLKKWIGHQISSQPIGGSIQTQTYGTTSGSSVIATQQIGFTGFDVYKTLSTAGVLFAYTSKYYGVSKVVFDAIYPDNKYKTTFTYNPGSEGIGAQEKDSEVELPPETLDQPNYEAYSHRLNYVTFIRNPDVPVFSWTHRSADRTASRNNFIYATKISQIPINKASRTSGGAVWNFQEGLYNGGPVMKLSGSGSQVINLRVATDAKGASQRYRIRIRYASDRAGKFTISSRSPENPATYSASIAYTNTMSTNASLTYSTFAYAESGPINLGISGSSRTFDISITKEAGAANLYIDRIEFIPVNTLFEAEEDLDVAKKAVNGLFTNEKDALQTSVTDYQVNQAANLIECLSDELYPNEKRMLWDAVKEAKRLVQARNLLQDTGFNRINGENGWTGSTGIEVVEGDVLFKDRSLRLTNAREIDTETYPTYLYQQIDESLLKPCTRYKLKGFIGSSQDLEIKLIRHRANQIVKNVPDNLLPDVRPVNSCGGVDRCSEQQYVDANLALENNGENGNMSFDSHAFSFHIDTGEIDLNENTGIWIVFKIPTTNGNATLGNLEFVEEGPLSGETLEWAQQQEQQWQDKMARKRAASEKTYYAAKQAIDRLFADYQDQKLNSGVEMSDLLAAQNLVQSIPYVYNDALPEIPGMNYTSFTELTNRLQQAWNLYDLQNAIPNGDFRNGLSNWNATSDVNVQQLSDTSVLVIPNWNSQVSQQFTVQPNYRYVLCVTARKEGVGDGYVIIRDGANQTETLTFNICDDDTGVLSTDQTSYITKTVEFTPSTEQVWIDMSETEGVFNIESVELVLEEE

SEQ ID NO: 494 - protein, 903 aa, Bacillus thuringiensis
MSPNNLNEYEIIDATPSTSVSNDSTRYPYANEPTNALQNMNYKDYLRMSEGYDNKYFANPEVFAAPGGITTGITIVTKLLGWLGLPFAGETGMALNFILGLLWPTSGNPWAELMILVEELINQKIEETVRNKALADLGNSGRALRSYLNAFEDWQKNPNIFRSKELVKERFSNAEHSLRTEMSSFAIRGFEIPLLATYAQAANLHLFLIKDIQIYGKEWGYTQADIDLFYREQVEFTKEYTEHCINIYNDGLNQLKGSNAKQWIAFNRFRREMTLTVLDVVALFPNYDVRMYPIKTTTELTRTIYTDPLGYTKTGSSSTPPWYNYGSSFSYIESVAIPAPSLVKWLSQIEIYSKSARATPQSADYWAGHTITYHYSGDDGQAVPNYGDRTNPVIVNRYNFEQADIYRVSSSVASSTTSGVKLLTTKAIFDGISTNNGLVSYMYEKLSNFFNELKDTITELPVQISSPPTYGDAEQYSHRLSYVSNAPTEYSSGGHLILGLIPVLGWTHTSLTQTNQIHSDSITQIPAVKANSVSSYVTVEKGTGFTGGDLVKFSTGFMSTGIQFNLKIEERKRYRIRIRYAADVNATLSALGLNDAFINIKSTMSQDTPLKYNDFQYAEADKTVHLYNPRFSLYLENSDQSGKSIYIDRIEFIPVDETYEAEQDLENAKKAVNALFTNTKDGLRPGVTDYEVNQAANLVECLSDDLYPNEKRLLFDAVREAKRLSEARNLLQDPDFQEINGENGWTASTGIEVVEGDALFKGRYLRLPGARQIDTETYPTYLYQKIDEGVLKPYTRYRLRGFVGRSQGLEIYTIRHQTNRIVKNVPDNLLPDASPGNAGDGINRCSEQKYVNSRLEGEKGLPNGSRSAEAHEFSIPIDTGEIDYNENAGIWVGFKITDPEQKQ

SEQ ID NO: 495 - protein, 1173 aa, Bacillus thuringiensis kenyae
MSPNNQNEYEIIDATPSTSVSNDSTRYPYANEPTNALQNMNYKDYLRMSEGYDNKYFANPEVFAAPGGITTGITIVTKLLGWLGLPFAGETGMALNFILGLLWPTSGNPWAELMILVEELINQKIEEAVRNKALADLANSGRALQSYLNAFEDWQKNPNIFRSKELVRERFANAEHSLRTEMSSFAIRGFEIPLLATYAQAANLHLFLIKDVQIYGKEWGYTQADIDLFYREQVEFTKEYTEHCINIYNDGLNQLKGSNAKQWIAFNRFRREMTLTVLDVVALFPNYDVRMYPIKTTTELTRTIYTDPLGYTKTGSSSTPPWYNYGSSFSYIESVAIPAPSLVKWLSQIEIYSKSARATPQSADYWAGHTITYHYSGNNDQVVANYGDRTNPVIVNRYNFEQADIYRVSSSVASSTTSGVKLLTTKAIFDGISTNNGLVSYMYEKLSNFFNELKDTITELPVQVSSSPTYGDAEQYSHRLSYVSNAPTEYSSGGHLILGLIPVLGWTHTSLTQTNQIHSDSITQIPAVKANSVSSYVTVEKGTGFTGGDLVKFSTGFMSTGIQFNLKIEERKRYRIRIRYAADVNARLSANHFGTTFINIKSTMSQDTPLKYNDFQYAETDGTLTLQDSHFSLFLEDSDQSGKSIYIDRIEFIPVDETYEAEQDLENAKKAVNALFTNTKDGLRPGVTDYEVNQAANLVECLSDDLYPNEKRLLFDAVREAKRLSEARNLLQDPDFQEINGENGWTASTGIEVVEGDALFKGRYLRLPGARQIDTETYPTYLYQKIDEGVLKPYTRYRLRGFVGRSQGLEIYTIRHQTNRIVKNVPDNLLPDASPGNAGDGINRCSEQKYVNSRLEGEKGLPNGSRSAEAHEFSIPIDTGEIDYNENAGIWVGFKITDPEGYATLGNLELVEEGPLSGDALERLQREEQQWKIQMTKRREETDRKYMIAKQAVDRLYADYQDQQLNPNVEITDITAAQNVIQSIPYVYNDAFPGLPGMNYTKFTELTDRLQQAWSLYDQRNAIPNGDFRNELSNWNTTAGVNVQQLNGTSVLVIPNWDAQVSQQFTVQPNQRYVLRVTARKEGVGNGYVSIRDGGNQTETLTFSASDYDTNGVYNIQASNTNGYNTNGVYNDQTGYITKTAEFIPHTNQVWIEMSETEGTFYIESVELIVDVE

SEQ ID NO: 496 - protein, 1157 aa, Bacillus thuringiensis
MSPNNQNEYEIIDMAPSTSVTNDSNRYPFANEPTNALQNMNYKDYLRMSEGYSPEYLTSLSPYSQFGTVDKIISIISLLNSAAGIPGLDFFTGLLQFILDFFAPEDPWAELMELVEQLIDQKITVATREKALAELRGLINGYLVYQQSLESWLENPNATRASIVREQYVALELDFVTSISSFAIAGQEVPLLAVYAQAANLHLLLLRDVSIFGEEWGLTVNEVNTFYIRQMTYTTEYSDYCVRIYNTGLNKLKGSSASSWVDYNRFRREMNLLVLDIIALFPNYDVRRYPMDTTTELTRVVYTDPIVFDERKGVASTHSWTAIAPSFSSIESLTRRPGLFTWLDQLTIFSKRISQPSVFINSWAGHKISTFRTQKTDILINTTHGDTNNPIKEFVVDTKKVEDIYQTIAYPHAVANEVFYLFGVPKVDFNMVPAGGSANSAHTLIFSDSTGGRLESITKNSEAELPPTESLSDTPQPNQVTYSHRLDYATIIKANKSYGSGYIPLLGWTHRSVDRQQTIYPQKITQIPAVKAFSYTESFNVNVIAGPGFTGGDLISLGHLENIYMKLNVPNPQKFRVRIRYAASTTSYLQITGLSNLAQSDRFEQTYSNENENNLMFENFQYVELRNIFSVDAPLENHQVSIQNYQGNGFVIIDRIEFIPVNATYDAENEAVNTTFTEGRNALQKYVTDYKVDQVDILVDCISGDLYPNEKRELQLLVKYAKRLSYSRNLLLDPTFDSINSSEENGWYGSNGIVIGNGDFVQKGNYLIFSGTNDTQYPTYLYQKIDESKLKEYSRYKLKGFIESSQDLEAYVRRYDAKHRTLDVSDNLLPDILPENTCGEPSRCAAQQYLDENPSSECSSMQDGILSDSHSFSLNIDTGSGNHNENLGIWVLFKISTLEGYAKFGNLEVIEDGPVIGEALARVKRQTTKWRNKLAQMTTETQAIYTRAKQALLNLFANAQDSHLKIDVTFAEIAAARKIVQSIREVYMSWLSVVPGVNHPIMTELSGRVQRAFQLYDVRNVVRNGRFLNGLSDWIVTSDVNVQEENGNMVLVLNNWDAQVLRNVKLYQDRGYVLRVTARKIGIEEGYITITDEEGHTDQLRFTACEEIDASNYFISGYITKELEFFPDTEKVHIEIGETEGEFLVESIELFLMEELC

SEQ ID NO: 497 - protein, 1121 aa, BGSC 4CC1
MEGGNNQGFINIEGRLSLEQVLAVSAGVASYILSNLGPFGVFFSYIIGAFWPTAPSDTRVWEAFMELIEARIDQKIQESTRKDAIARLQGLGAASEVYQESLESWLENQNDARAMSVVRQQFVAFELDFVTAMPFFERSGDEILLLAVYAQAANLHLLLLRDASLYGADWGMEPYDIANYYNRQKERTATYSNHCMEWYKKGLDELWSAGGYGGDVWQDYNDFRREMTLSVLDFVALFPNYDTHLYPIEVKGELTREIYTPGINIDIDRGRLGKVTLENALVNSPRLFSWLKEIQLFTNINFNPRWKFLSATRIGYKLTGYRSVNFEPYEGFYFEGLFQSNFTLNDYQEIYIVDVTRFGSLYDTPTAITAMTFFKDDNTTFNYSSNTPSGEPMITSGFYLPGIDGSEEPTSNNFSHRLSTINTYNTTNQTFYHTFGWTHVSVDRNNTIVSNKITQIPFVKANTGNVVRGPGHTGGDLVVFKPAARPDIVLRVGNTRLQSYRVRVRYASNADISLELDTTYEKTNIHLQKTFNSSEAEDLTYDNFQYAEADNIVWLGQDLSQYIEFQNAITNDSTAIAYFERVEFLPVGATYEAEQDLETAKKVVNALFTNTKNALQMSVTDYEVTQAANLVECVSDELFPNEKRLLFDAVKEAKRLSGIRNLLQDSDFQEINGENGWVGSIEIEIREGDTLFKGYSLRLPSAREIYMEMFPTYLHQKIEESRLKPYTRYRLRGFVSSSQDLEIFSIRHETNRIVKNVSDDLLPNLSSYYTCGGVNRCSTQKYVYNRLEFQNSLSSGNRYSDAHSFSIPIDTGKIDLNDNTGIWIAFKLATTGGYATLGNLELVEEAPLIGDTLERVQREDQQWKSQMTRKREEAERKYMAAKQAIDRLYADYQDHQLNPNVEITDITATQHLVQSLPYVNNDVLQEIPGMNYTRFTELTNRLQQAWELYGLRNMIANGDFRNGLNDWDATSGVNIQQINHTSVLVISNWDAQISKQFTVQPNQKYVLRVTVRKEGSGDGYVTIRDGGNHTETLTFNTCDYERSNVYNEKVFQSNDYGTNNVYHTQTTNANRYTTNSLYNDGTGYVTKTVEFIPYTEQVWIEMSETEGVFYVESIEFILEEV

SEQ ID NO: 498 - protein, 1173 aa, BtQ52-7
MSPNNQNEYEIIDASSPTSVSNNSVKYPLASDQTTTLQNMNYKDYLRMTERENPELSRNPETFISAQDAVGTGIDIVSTIISGVGIPVVGEVLSILGAILGLFWPSSGEDVWELFMERVEELIDQKIGTFAKDTAISNLGKSRIAVTSYRNALEAWQKNPNNARSISLVRERFADAEHTLRTNMSSFVISGYQIPFLATYAQAANLHLLVMKDVQIYGIQWGYTQGEIDLFYREQADFTAQYSDYCVKWYNAGLDKLRGTSAQQWVNYDRFRREMTVMALDIVALFPNYDVRMYPMQTNAELTREIYTPVGTFVTEAGSSFRRVISWHDMSTPNFPSFSTIENIVVRAPHMFRVLRELEISSMRRNNGSIEFYNYWSGQMTGHSNINNYSKISRVSGGDLTNDTTNVPLNNRNIYRAIWNYIGRVENSLLGVNPVDFFFTNNTRFTYNRPRSILWGGAGELRIDSGEELPFKSHTDYSHIVSSASSFPLFSNFGTRLGSVVTFGWTHSSVDLENTIHPDKITQIPAVKAFASSVTAEAVKGVGNTGGNLVRLYSGGLYTAITMRFKVAERKQYRVRIRYAANVNATLSLRNYTSTTNYTSTTINLTSTMNEKEPSSYNDFRYVEATRVISLNNHTEFRMIEESSSQIGGYIYIDKIEFIPVDATYEAEQDLDVAKKAVNGLFTNTKDALQTSITDYQVNQAANLVECLSDELYPNEKRMLWHAVKEAKRLVQARNLLQDTGFNVINGENGWTGSTGIEVVEGDVLFKDRSLRLPSAREIDTETYPTYLYQQIDESLLKPYTRYRLRGFIGSSQDLEIKLIRHRANQIVKNVPDNLLPDVRPVNSCGGVDRCSEQQYVDANLALENNGENRNMSSDSHAFSFHMDTGEIDLNENTGIWVVFKIPTTNGYATLGNLELVEEGPLSGEVLERAQQQEQQWQDKMVRKRTASEKANYAAKQAIDRLFADYQDQQLNSGVEMSDLLAAQNLIQSIPYVYNEMLPEIPGMNYTNFTELTNRLQQAWNLYDLRNAIPNGDFRNGLSDWNATSDINVQQLNDTSILVIPNWNSQVSQQFTVQPNYRYVLRVTARKEGVGDGYVSIRDGGNQTETLTFSASDYNTPASNTNGYNTNGVYNDQTGYITKTVTFIPYTDQVWIEMSETEGVFNIESVELVLEEE

SEQ ID NO: 499 - protein, 1204 aa, Bacillus thuringiensis R36
MSPNNQNEYEIIDTPSRTSVSNDSVRYPFANEPTTDLNNMNYKDYLRMSEVDDATFLSNPEAFIDSKSVQTIIGIVGKGLGVLGVPGAAAIAQFFSFLVGQLWPSTGEFIWEQIIEQVEALVDQKITDYARNKALSEVQGLGEAFAVYQQSLQTWQENRTDSRVRGVIIQQFIALDLDFVNKMPSFAVSGQEVPLLAVYALAANIHLLLLRDASLFGAEWGFATPEISDYYNRQIQLITKYTDYCVNWYNTGLGYMRKVDSTGSGNRQTRNWLRYHQFRREMTLMVLDVLALFPGYDIRTYPGNVHFQLTREVYTDPIVFNPSSKPSGKFCDPWESRYEYDYLSEMENVLVRPPHLFEIFVNNTYFTGRGTILFNDNEYINYMIGNKITYRYTNDDTRYERNYGSSSTETNSLIFGLSDEFDIFNISSVAANLANYYGNRYGFPYARWYCGSGLGGSGYNTFTYSRTHTTNQICTQSYDAQNELPPEGSQSQADYSHRLAHIASYTIPVKSGGGISGNIPLYAWTHRSASKFNYITPNRINHLPMVKSYILPTGTSVVQGPGFTGGNLLKRATSGQIAKLKVELINFGLSAQYRVRIRYASTSTLNFRVFQTGTLVNDLNFNRTMSRGESLTHNKFKFASFTTPFMFTSKFSELRIDVSNLSSGEEVYVDSIEVIPVNATYEAETNLEVAKKAVMSCLRMQRALQTDVTDYQVNQVANLIECVSDEVYPNEKRLLFDAVKEAKRLDQARNLLQDPNFQEINGENGWTGSTGIEIVEGDLPFKDRSLRLPSAREMERETYPTYIYQKIEESRLKPNTRYKFRGFIGSSQDLEIYVIRHQAYRVIKNVSNNLLPNMRPINACGGVDRCNEQKQVNTVLGLENNVPNGNTMSDSHEFSIPVDTGELNYNENPGIWVVFKITTTDGYATVGNIELVEEETLSGEALERVQQQEKRWQDQMARRRAETENRYGIAKQAIDRLFVDYSKVSSSIEISDLTAAQNLVQSIPYVYNEMLPEIPGMNYTSVTELTNRLQQAWNLYDQRNSIQNGDFRNDVRNWNVTPGVNIQQMNDTSVLVIPNWDSQVSQQITVQPNRRYVLRVTARKEGNGDGYVTIRDGANHTETLTFNTCDYDGSSVYDNQAFNANNDVYTTQSSNTNRYNTNGVYHDQTSYITKTVEFIPYTEQVWIEMSETEGVFYVESVELIVEEM

SEQ ID NO: 500 - protein, 802 aa, Bacillus thuringiensis
MNQNKHGIIGASNCGCASDDVAKYPLANNPYSSALNLNSCQNSSILNWINIIGDAAKEAVSIGTTIVSLITAPSLTGLISIVYDLIGKVLGGSSGQSISDLSICDLLSIIDLRVSQSVLNDGIADFNGSVLLYRNYLEALDSWNKNPNSASAEELRTRFRIADSEFDRILTRGSLTNGGSLARQNAQILLLPSFASAAFFHLLLLRDATRYGTNWGLYNATPFINYQSKLVELIELYTDYCVHWDNRGSTELRQRGPSATAWLEFHRYRREMTLMGLEIVASFSSLDITNYPIETDFQLSRVIYTDPIGFVHRSSLRGESWFSFVNRANFSDLENAIPNPRPSWFLNNMIISTGSLTLPVSPSTDRARVWYGSRDRISPANSQFITELISGQHTTATQTILGRNIFRVDSQACNLNDTTYGVNRAVFYHDASEGSQRSVYEGYIRTTGIDNPRVQNINTYLPGENSDIPTPEDYTHILSTTINLTGGLRQVASNRRSSLVMYGWTHKSLARNNTINPDRITQIPLTKVDTRGTGVSYVNDPGFIGGALLQRTDHGSLGVLRVQFPLHLRQQYRIRVRYASTTNIRLSVNGSFGTISQNLPSTMRLGEDLRYGSFAIREFNTSIRPTASPDQIRLTIEPSFIRQEVYVDRIEFIPVNPTREAKEDLEAAKKAVASLFTRTRDGLQVNVKDYQVDQAANLVSCLSDEQYGYDKKMLLEAVRAAKRLSRERNLLQDPDFNTINSTEENGWKASNGVTISEGGPFYKGRAIQLASARENYPTYIYQKVDASELKPYTRYRLDGFVK

SEQ ID NO: 501 - protein, 1156 aa, Bacillus thuringiensis galleriae
MNQNKHGIIGASNCGCASDDVAKYPLANNPYSSALNLNSCQNSSILNWINIIGDAAKEAVSIGTTIVSLITAPSLTGLISIVYDLIGKVLGGSSGQSISDLSICDLLSIIDLRVSQSVLNDGIADFNGSVLLYRNYLEALDSWNKNPNSASAEELRTRFRIADSEFDRILTRGSLTNGGSLARQNAQILLLPSFASAAFFHLLLLRDATRYGTNWGLYNATPFINYQSKLVELIELYTDYCVHWYNRGFNELRQRGTSATAWLEFHRYRREMTLMVLDIVASFSSLDITNYPIETDFQLSRVIYTDPIGFVHRSSLRGESWFSFVNRANFSDLENAIPNPRPSWFLNNMIISTGSLTLPVSPSTDRARVWYGSRDRISPANSQFITELISGQHTTATQTILGRNIFRVDSQACNLNDTTYGVNRAVFYHDASEGSQRSVYEGYIRTTGIDNPRVQNINTYLPGENSDIPTPEDYTHILSTTINLTGGLRQVASNRRSSLVMYGWTHKSLARNNTINPDRITQIPLTKVDTRGTGVSYVNDPGFIGGALLQRTDHGSLGVLRVQFPLHLRQQYRIRVRYASTTNIRLSVNGSFGTISQNLPSTMRLGEDLRYGSFAIREFNTSIRPTASPDQIRLTIEPSFIRQEVYVDRIEFIPVNPTREAKEDLEAAKKAVASLFTRTRDGLQVNVKDYQVDQAANLVSCLSDEQYGYDKKMLLEAVRAAKRLSRERNLLQDPDFNTINSTEENGWKASNGVTISEGGPFYKGRAIQLASARENYPTYIYQKVDASELKPYTRYRLDGFVKSSQDLEIDLIHHHKVHLVKNVPDNLVSDTYPDDSCSGINRCQEQQMVNAQLETEHHHPMDCCEAAQTHEFSSYIDTGDLNSSVDQGIWAIFKVRTTDGYATLGNLELVEVGPLSGESLEREQRDNTKWSAELGRKRAETDRVYQDAKQSINHLFVDYQDQQLNPEIGMADIMDAQNLVASISDVYSDAVLQIPGINYEIYTELSNRLQQASYLYTSRNAVQNGDFNNGLDSWNATAGASVQQDGNTHFLVLSHWDAQVSQQFRVQPNCKYVLRVTAEKVGGGDGYVTIRDDAHHTETLTFNACDYDINGTYVTDNTYLTKEVVFHPETQHMWVEVNETEGAFHIDSIEFVETEK

SEQ ID NO: 502 - protein, 1151 aa, Bacillus thuringiensis DSIR517
MNQNKHGIIGASNCGCASDDVAKYPLANNPYSSALNLNSCQNSSILNWINIIGDAAKEAVSIGTTIVSLITAPSLTGLISIVYDLIGKVLGGSSGQSISDLSICDLLSIIDLRVSQSVLNDGIADFNGSVLLYRNYLEALDSWNKNPNSASAEELRTRFRIADSEFDRILTRGSLTNGGSLARQNAQILLLPSFASAAFFHLLLLRDATRYGTNWGLYNATPFINYQSKLVELIELYTDYCVHWYNRGFNELRQRGTSATAWLEFHRYRREMTLMVLDIVASFSSLDITNYPIETDFQLSRVIYTDPIGFVHRSSLRGESWFSFVNRANFSDLENAIPNPRPSWFLNNMIISTGSLTLPVSPSTDRARVWYGSRDRISPANSQFITELISGQHTTATQTILGRNIFRVDSQACNLNDTTYGVNRAVFYHDASEGSQRSVYEGYIRTTGIDNPRVQNINTYLPGENSDIPTPEDYTHILSTTINLTGGLRQVASNRRSSLVMYGWTHKSLARNNTINPDRITQIPLTKVDTRGTGVSYVNDPGFIGGALLQRTDHGSLGVLRVQFPLHLRQQYRIRVRYASTTNIRLSVNGSFGTISQNLPSTMRLGEDLRYGSFAIREFNTSIRPTASPDQIRLTIEPSFIRQEVYVDRIEFIPVNPTREAKEDLEAAKKAVASLFTRTRDGLQVNVKDYQVDQAANLVSCLSDEQYGYDKKMLLEAVRAAKRLSRERNLLQDPDFNTINSTEENGWKASNGVTISEGGPFYKGRAIQLASARENYPTYIYQKVDASELKPYTRYRLDGFVKSSQDLEIDLIHHHKVHLVKNVPDNLVSDTYPDDSCSGINRCQEQQMVNAQLETEHHHPMDCCEAAQTHEFSSYIDTGDLNSSVDQGIWAIFKVRTTDGYATLGNLELVEVGPLSGESLEREQRDNTKWSAELGRKRAETDRVYQDAKQSINHLFVDYQDQQLNPEIGMADIMDAQNLVASISDVYSDAVLQIPGINYEIYTELSNRLQQASYLYTSRNAVQNGDFNNGLDSWNATAGASVQQDGNTHFLVLSHWDAQVSQQFRVQPNCKYVLRVTAEKVGGGDGYVTIRDDAHHTETLTFNACDYDINGTYVTDNTYLTKEVVFHPETQHMWVEVNETEGAFHIDSIEF

SEQ ID NO: 503 - protein, 1144 aa, Bacillus thuringiensis galleriae
VFELKTCIWHAFFLTKLSSYKDYLKMSEGDYIDSYINPGNVRTGLQTGIDIVAVVVGALGGPVGGILTGFLSTLFGFLWPSNDQAVWEAFIEQMEELIEQRISDQVVRTALDDLTGIQNYYNQYLIALKEWEERPNGVRANLVLQRFEILHALFVSSMPSFGSGPGSQRFQAQLLVVYAQAANLHLLLLADAEKYGARWGLRESQIGNLYFNELQTRTRDYTNHCVNAYNNGLAGLRGTSAESWLKYHQFRREATLMAMDLIALFPYYNTRRYPIAVNPQLTREVYTDPLGVPSEESSLFPELRCLRWQETSAMTFSNLENAIISSPHLFDTINNLMIYTGSFSVHLTNQLIEGWIGHSVTSSLLASGPTTVLRRNYGSTTSIVNYFSFNDRDVYQINTRSHTGLGFQNAPLFGITRAQFYPGGTYSVTQRNALTCEQNYNSIDELPSLDPNEPISRSYSHRLSHITSYLHRVLTIDGINIYSGNLPTYVWTHRDVDLTNTITADRITQLPLVKSFEIPAGTTVVRGPGFTGGDILRRTGVGTFGTIRVRTTAPLTQRYRIRFRFASTTNLFIGIRVGDRQVNYFDFGRTMNRGDELRYESFATREFTTDFNFRQPQELISVFANAFSAGQEVYFDRIEIIPVNPAREAKEDLEAAKKAVASLFTRTRDGLQVNVKDYQVDQAANLVSCLSDEQYGYDKKMLLEAVRAAKRLSRERNLLQDPDFNTINSTEENGWKASNGVTISEGGPFYKGRALQLASARENYPTYIYQKVDASELKPYTRYRSDGFVKSSQDLEIDLIHHHKVHLVKNVPDNLVSDTYPDDSCSGINRCQEQQMVNAQLETEHHHPMDCCEAAQTHEFSSYIDTGDLNSSVDQGIWAIFKVRTTDGYATLGNLELVEVGPLSGESLEREQRDNTKWSAELGRKRAETDRVYQDAKQSINHLFVDYQDQQLNPEIGMADIMDAQNLVASISDVYSDAVLQIPGINYEIYTELSNRLQQASYLYTSRNAVQNGDFNNGLDSWNATAGASVQQDGNTHFLVLSHWDAQVSQQFRVQPNCKYVLRVTAEKVGGGDGYVTIRDGAHHTETLTFNACDYDINGTYVTDNTYLTKEVIFYSHTEHMWVEVNETEGAFHIDSIEFVETEK

SEQ ID NO: 504 - protein, 1164 aa, Bacillus thuringiensis B-SC5
MNRNNQNEYEVIDTSTCGCPSGDVMQYPLANDPNAALQNMNYKEYLQMSEGDYIDSYINPGNVRTGLQTGIDIVAVVVGALGGPVGGILTGFLSTLFGFLWPSNDQAVWEAFIEQMEELIEQRISDQVVRTALDDLTGIQNYYNQYLIALKEWEERPNGVRANLVLQRFEILHALFVSSMPSFGSGPGSQRFQAQLLVVYAQAANLHLLLLADAEKYGARWGLRESQIELYFNELQTRTRDYTNHCVNAYNNGLAGLRGTSAESWLKYHQFRREATLMAMDLIALFPYYNTRRYPIAVNPQLTREVYTDPLGVPSEESSLFPELRCLRWQETSAMTFSNLENAIIRPPHLFDTINNLMIYTGSFRFTNNQLIEGWIGHSVTSSLLASGPTTVVRRNYGSTTSIVNYFSFNDRDVYQINTRSHTGLGFQNAPLFGITRAQFYPGGTYSVTQRNALTCEQNYNSIDELPSLDPNEPISRSYSHRLSHITSYLHRVLTIDGINIYSGNLPTYVWTHRDVDLTNTITADRITQLPLVKSFEIPAGTTVVRGPGFTGGDILRRTGVGTFGTIRVRTTAPLTQRYRIRFRFASTTNLFIGIRVGDRQVNYFDFGRTMNRGDELRYESFATREFTTDFNFRQPQELISVFANAFSAGQEVYFDRIEIIPVNPAREAKEDLEAAKKAVASLFTRTRDGLQVNVKDYQVDQAANLVSCLSDEQYGYDKKMLLEAVRAAKRLSRERNLLQDPDFNTINSTEENGWKASNGVTISEGGPFYKGRALQLASARENYPTYIYQKVDASELKPYTRYRLDGFVKSSQDLEIDLIHHHKVHLVKNVPDNLVSDTYPDDSCSGINRCQEQQMVNAQLETEHHHPMDCCEAAQTHEFSSYIDTGDLNSSVDQGIWAIFKVRTTDGYATLGNLELVEVGPLSGESLEREQRDNTKWSAELGRKRAETDRVYQDAKQSINHLFVDYQDQQLNPEIGMADIMDAQNLVASISDVYSDAVLQIPGINYEIYTELSNRLQQASYLYTSRNAVQNGDFNNGLDSWNATAGASVQQDGNTHFLVLSHWDAQVSQQFRVQPNCKYVLRVTAEKVGGGDGYVTIRDGAHHTETLTFNACDYDINGTYVTDNTYLTKEVIFYSHTEHMWVEVNETEGAFHIDSIEFVETEK

SEQ ID NO: 505 - protein, 1163 aa, Bacillus thuringiensis japonensis
MNRNNQNEYEVIDTSTCGCPSGDVMQYPLANDPNAALQNMNYKEYLQMYGGDYADAFINPGNVRTGLQTGIDIVALLVGTLGGAVGGILTGLLSTLFGFLWPSNDQAVWEAFIEQMEELIEQRISDQVVRTALDNLTGIQNYYNQYLLAFEEWEEAPNSVRSNLVLQRFENLHALFVSSMPSFGSGPGSQRFEAQLLLVYAQAANLHLLLLRDAEIYGARWGLRESQIQLYFDELQNNTRDYTNHCVNAYNNGLEQVRGTNAASWLKYHQFRRETTLTAMDLVALFPYYNLRQYPIAVNPQLTREVYTDPLGVPFEESNPSSEIRCSRWQDTSAMTFSNLENALVRPPHLFDTIRNLRIYTGTFRVNNNNFIEGWIGHSVTNNRLGISTEFTRNYGITTPIINSYNFANGDVYQINTRSNTSLIAFENAPLFGITRAQFQPGGTYSVTQRTLLCEQNYNSTDELPSLDPDEPISRSYSHRLSHITSYLHRVFTIDGNNIYSGNLPTYVWTHRDVDLTNTITADRITHLPLIKSNVQRSGLPVKGPGFTGGDVLRSSSSDADVSIIGVSAGAPLTQQYRIRVRYASNVDVTIRFVRHNTHSLLGIGTLSRTMNSGEESRYESYRTVDVITNFRLNSSSEQIRIVTEGLRANGQLYLDSLEFIPINPTREAEEDLEAAKKAVASLFTRTRDGLQANVTDYQVDRAANLVLCLSDEQYAHDKKMLLEAVRAAKRLSRERNLLQDPDFNEINSTEDSGWKTSNGIIISEGGPFFKGRALQLASARENYPTYIYQKVDSSMLKPYTRYKLDGFVQSSQDLEIELIHHHKVHLVKNVPDNLVLDTYPDGSCNGINRCEEQQMVNSQLETEHHPMDCCEASQTHEFSSYIHTGDLNASVDQGIWVVLKIRTTDGSATLGNLELVEVGPLSGESLEREQRDNAKWNAELGRKRAEADRVYQGAKQAINHLFVDYQDQQLNPEVGLAEISEARNLIESISDVYCDAVLRIPGINYEMYTELSNRLQQAAYLYTSRNAVQNGDFNSGLDSWNATTDATVQQDGNMYFLVLSHWDAQVSQQFRVQPNCKYVLRVTAKKVGNGDGYVTIQDGAHHRETLTFNACDYDVNGTHVNDNSYITKELEFYPKTEHMWVEVSETEGTFYIDSIELIETQE

SEQ ID NO: 506 - protein, 1157 aa, Bacillus thuringiensis tolworthi
MNRNNQNEYEIIDAPHCGCPSDDDVRYPLASDPNAALQNMNYKDYLQMTDEDYTDSYINPSLSISGRDAVQTALTVVGRILGALGVPFSGQIVSFYQFLLNTLWPVNDTAIWEAFMRQVEELVNQQITEFARNQALARLQGLGDSFNVYQRSLQNWLADRNDTRNLSVVRAQFIALDLDFVNAIPLFAVNGQQVPLLSVYAQAVNLHLLLLKDASLFGEGWGFTQGEISTYYDRQLELTAKYTNYCETWYNTGLDRLRGTNTESWLRYHQFRREMTLVVLDVVALFPYYDVRLYPTGSNPQLTREVYTDPIVFNPPANVGLCRRWGTNPYNTFSELENAFIRPPHLFDRLNSLTISSNRFPVSSNFMDYWSGHTLRRSYLNDSAVQEDSYGLITTTRATINPGVDGTNRIESTAVDFRSALIGIYGVNRASFVPGGLFNGTTSPANGGCRDLYDTNDELPPDESTGSSTHRLSHVTFFSFQTNQAGSIANAGSVPTYVWTRRDVDLNNTITPNRITQLPLVKASAPVSGTTVLKGPGFTGGGILRRTTNGTFGTLRVTVNSPLTQQYRLRVRFASTGNFSIRVLRGGVSIGDVRLGSTMNRGQELTYESFFTREFTTTGPFNPPFTFTQAQEILTVNAEGVSTGGEYYIDRIEIVPVNPAREAEEDLEAAKKAVASLFTRTRDGLQVNVTDYQVDQAANLVSCLSDEQYGHDKKMLLEAVRAAKRLSRERNLLQDPDFNTINSTEENGWKASNGVTISEGGPFFKGRALQLASARENYPTYIYQKVDASVLKPYTRYRLDGFVKSSQDLEIDLIHHHKVHLVKNVPDNLVSDTYSDGSCSGINRCDEQHQVDMQLDAEHHPMDCCEAAQTHEFSSYINTGDLNASVDQGIWVVLKVRTTDGYATLGNLELVEVGPLSGESLEREQRDNAKWNAELGRKRAEIDRVYLAAKQAINHLFVDYQDQQLNPEIGLAEINEASNLVESISGVYSDTLLQIPGINYEIYTELSDRLQQASYLYTSRNAVQNGDFNSGLDSWNTTMDASVQQDGNMHFLVLSHWDAQVSQQLRVNPNCKYVLRVTARKVGGGDGYVTIRDGAHHQETLTFNACDYDVNGTYVNDNSYITEEVVFYPETKHMWVEVSESEGSFYIDSIEFIETQE

SEQ ID NO: 507 - protein, 1156 aa, Bacillus thuringiensis
MNRNNQNEYEIIDAPHCGCPSDDDVRYPLASDPNAALQNMNYKDYLQMTDEDYTDSYINPSLSISGRDAVQTALTVVGRILGALGVPFSGQIVSFYQFLLNTLWPVNDTAIWEAFMRQVEELVNQQITEFARNQALARLQGLGDSFNVYQRSLQNWLADRNDTRNLSVVRAQFIALDLDFVNAIPLFAVNGQQVPLLSVYAQAVNLHLLLLKDASLFGEGWGFTQGEISTYYDRQLELTAKYTNYCETWYNTGLDRLRGTNTESWLRYHQFRREMTLVVLDVVALFPYYDVRLYPTGSNPQLTREVYTDPIVFNPPANVGLCRRWGTNPYNTFSELENAFIRPPHLFDRLNSLTISSNRFPVSSNFMDYWSGHTLRRSYLNDSAVQEDSYGLITTTRATINPGVDGTNRIESTAVDFRSALIGIYGVNRASFVPGGLFNGTTSPANGGCRDLYDTNDELPPDESTGSSTHRLSHVTFFSFQTNQAGSIANAGSVPTYVWTRRDVDLNNTITPNRITQLPLVKASAPVSGTTVLKGPGFTGGGILRRTTNGTFGTLRVTVNSPLTQRYRVRVRFASSGNFSIRILRGNTSIAYQRFGSTMNRGQELTYESFVTSEFTTNQSDLPFTFTQAQENLTILAEGVSTGSEYFIDRIEIIPVNPAREAEEDLEAAKKAVANLFTRTRDGLQVNVTDYQVDQAANLVSCLSDEQYGHDKKMLLEAVRAAKRLSRERNLLQDPDFNTINSTEENGWKASNGVTISEGGPFFKGRALQLASARENYPTYIYQKVDASVLKPYTRYRLDGFVKSSQDLEIDLIHHHKVHLVKNVPDNLVSDTYSDGSCSGINRCDEQHQVDMQLDAEHHPMDCCEAAQTHEFSSYINTGDLNASVDQGIWVVLKVRTTDGYATLGNLELVEVGPLSGESLEREQRDNAKWNAELGRKRAEIDRVYLAAKQAINHLFVDYQDQQLNPEIGLAEINEASNLVESISGVYSDTLLQIPGINYEIYTELSDRLQQASYLYTSRNAVQNGDFNSGLDSWNTTMDASVQQDGNMHFLVLSHWDAQVSQQLRVNPNCKYVLRVTARKVGGGDGYVTIRDGAHHQETLTFNACDYDVNGTYVNDNSYITEEVVFYPETKHMWVEVSESEGSFYIDSIEFIETQE

SEQ ID NO: 508 - protein, 1169 aa, Bacillus thuringiensis japonensis N141
MNRNNQNEYEVIDAPHCGCPADDVVKYPLTDDPNAGLQNMNYKEYLQTYGGDYTDPLINPNLSVSGKDVIQVGINIVGRLLSFFGFPFSSQWVTVYTYLLNSLWPDDENSVWDAFMERVEELIDQKISEAVKGRALDDLTGLQYNYNLYVEALDEWLNRPNGARASLVSQRFNILDSLFTQFMPSFGSGPGSQNYATILLPVYAQAANLHLLLLKDADIYGARWGLNQTQIDQFHSRQQSLTQTYTNHCVTAYNDGLAELRGTTAESWFKYNQYRREMTLTAMDLVALFPYYNLRQYPDGTNPQLTREVYTDPIAFDPLEQPTTQLCRSWYINPAFRNHLNFSVLENSLIRPPHLFERLSNLQILVNYQTNGSAWRGSRVRYHYLHSSIIQEKSYGLLSDPVGANINVQNNDIYQIISQVSNFASPVGSSYSVWDTNFYLSSGQVSGISGYTQQGIPAVCLQQRNSTDELPSLNPEGDIIRNYSHRLSHITQYRFQATQSGSPSTVSANLPTCVWTHRDVDLDNTITANQITQLPLVKAYELSSGATVVKGPGFTGGDVIRRTNTGGFGAIRVSVTGPLTQRYRIRFRYASTIDFDFFVTRGGTTINNFRFTRTMNRGQESRYESYRTVEFTTPFNFTQSQDIIRTSIQGLSGNGEVYLDRIEIIPVNPAREAEEDLEAAKKAARQNLFTRTRDGLQVNVTDYQVDQAANLVSCLSDEQYGHDKKMLLEAVRAAKRLSRERNLLQDPDFNTINSTEENGWKASNGVTISEGGPFFKGRALQLASARENYPTYIYQKVDASVLKPYTRYRLDGFVKSSQDLEIDLIHYHKVHLVKNVPDNLVSDTYSDGSCSGMNRCEEQQMVNAQLETEHHHPMDCCEAAQTHEFSSYINTGDLNASVDQGIWVVLKVRTTDGYATLGNLELVEVGPLSGESLEREQRDNAKWNAELGRKRAEIDRVYLAAKQAINHLFVDYQDQQLNPEIGLAEINEASNLVESISGVYSDTLLQIPGINYEIYTELSDRLQQASYLYTSRNAVQNGDFNSGLDSWNTTTDASVQQDGNMHFLVLSHWDAQVSQQLRVNPNCKYVLRVTARKVGGGDGYVTIRDGAHHQETLTFNACDYDVNGTYVNDNSYITEEVVFYPETKHMWVEVSESEGSFYIDSIEFIETQE

SEQ ID NO: 509 - protein, 645 aa, Bacillus thuringiensis japonensis
HCGCPADDVVKYPLTDDPNAGLQNMNYKEYLQTYGGDYTDPLINPNLSVSGKDVIQVGINIVGRLLSFFGFPFSSQWVTVYTYLLNSLWPDDENSVWDAFMERVEELIDQKISEAVKGRALDDLTGLQYNYNLYVEALDEWLNRPNGARASLVSQRFNILDSLFTQFMPSFGSGPGSQNYATILLPVYAQAANLHLLLLKDADIYGARWGLNQTQIDQFHSRQQSLTQTYTNHCVTAYNDGLAELRGTTAESWFKYNQYRREMTLTAMDLVALFPYYNLRQYPDGTNPQLTREVYTDPIAFDPLEQPTTQLCRSWYINPAFRNHLNFSVLENSLIRPPHLFERLSNLQILVNYQTNGSAWRGSRVRYHYLHSSIIQEKSYGLLSDPVGANINVQNNDIYQIISQVSNFASPVGSSYSVWDTNFYLSSGQVSGISGYTQQGIPAVCLQQRNSTDELPSLNPEGDIIRNYSHRLSHITQYRFQATQSGSPSTVSANLPTCVWTHRDVDLDNTITANQITQLPLVKAYELSSGATVVKGPGFTGGDVIRRTNTGGFGAIRVSVTGPLTQRYRIRFRYASTIDFDFFVTRGGTTINNFRFTRTMNRGQESRYESYRTVEFTTPFNFTQSQDIIRTSIQGLSGNGEVYLD

SEQ ID NO: 510 - protein, 1169 aa, Bacillus thuringiensis kurstaki DP1019
MNRNHQNEYEIIDAPHCGCPSDDVVKYPLTDDPNAGLQNMNYKEYLQMYGGDYTDPLINPNLSVSGKDVIQVGINIVGRLLSFFGFPFSSQWVTVYTYLLNSLWPDDENSVWDAFMKRIEELIDQKISEAVKGRALDELTGLQDNYNLYVEALDEWLNRPNGARASLVSQRFNILDSLFTQFMPSFGSGPGSQNYSTILLPVYAQAANLHLLLLKDADIYGARWGLNQTQIDQFHSRQQSLTRTYTNHCVTTYNDGLAELRGTSVESWLKYHQYRREMTVTAMDLVALFPYYNVRQYPNGANPQLTREVYTDPIVFNPPEPPSGAFCESFYNIRAARERLTFSQLENAIIRPPRLFERFQALGIYTGEARLNQNSAPTNYWIGHFIRNTRLGDSTTITTNYGTTNNRLTNFIPPTTSDVYQINSISSNLASALSTLFGVTRAQFHYGSGIIWSYVGQNNVLPQCHQNYNSIEELPNQSDEPTVRSYSHRLSHITSFNFSVQLNNPVISLGNMPVYVWTHRSVDLNNTITSDRITQLPAVKASTLGAGAIVVKGPGFTGGDVIRRTSVGDFGTIRVSVTGSLTQQYRIRFRYASTIDFDFFVIRGGTTINNFRFTHTMSSGEESRYESYRTVEFSTPFNFTQSQDIIRTSIQGLSGNGEVYLDRIEIIPVNPTREAEEDLEDAKKAVAGLFTRTRDGLQVNVTDYQVDRAANLVSCLSDEQYSHDKKMLMEAVRAAKRLSRERNLLQDPDFNEINSTEENGWKASNGIIISEGGPFFKGRVLQLASARENYPTYIYQKVDASVLKPYTRYRLDGFVKSSEDLEIDLVHQHKVHLVKNVPDNLVSDTYPDGSCRGVNRCDEQHQVDVQIDTEHHPMDCCEAAQTHEFSSYINTGDLNSSVDQGIWVVLKVRTADGYATLGNLELVEVGPLSGESLEREQRDNAKWNAELGRERAETDRVYLAAKQAINHLFVDYQDQQLNPEIGLAEINEASNLVESITGVYSDTVLQIPGISYEIYTELSDRLQQASYLYTSRNAVQNGDFDSGLDSWNATTDASVQQDGNMHFLVLSHWDAQVTQQLRVNPNCKYVLRVTARKVGGGDGYVTIRDGAHHRETLTFNACDYDVNGTYVNDNTYITKEVVFYPHTEHTWVEVSESEGAFYIDSIELIETQE

SEQ ID NO: 511 - protein, 1150 aa, Bacillus thuringiensis aizawai SSK-10
MNRNNPNEYEIIDAPYCGCPSDDDVRYPLASDPNAAFQNMNYKEYLQTYDGDYTGSLINPNLSINPRDVLQTGINIVGRILGFLGVPFAGQLVTFYTFLLNQLWPTNDNAVWEAFMAQIEELIDQKISAQVVRNALDDLTGLHDYYEEYLAALEEWLERPNGARANLVTQRFENLHTAFVTRMPSFGTGPGSQRDAVALLTVYAQAANLHLLLLKDAEIYGARWGLQQGQINLYFNAQQERTRIYTNHCVETYNRGLEDVRGTNTESWLNYHRFRREMTLMAMDLVALFPFYNVRQYPNGANPQLTREIYTDPIVYNPPANQGICRRWGNNPYNTFSELENAFIRPPHLFERLNRLTISRNRYTAPTTNSFLDYWSGHTLQSQHANNPTTYETSYGQITSNTRLFNTTNGARAIDSRARNFGNLYANLYGVSSLNIFPTGVMSEITNAANTCRQDLTTTEELPLENNNFNLLSHVTFLRFNTTQGGPLATLGFVPTYVWTREDVDFTNTITADRITQLPWVKASEIGGGTTVVKGPGFTGGDILRRTDGGAVGTIRANVNAPLTQQYRIRLRYASTTSFVVNLFVNNSAAGFTLPSTMAQNGSLTYESFNTLEVTHTIRFSQSDTTLRLNIFPSISGQEVYVDKLEIVPINPTREAEEDLEDAKKAVASLFTRTRDGLQVNVTDYQVDQAANLVSCLSDEQYGHDKKMLLEAVRAAKRLSRERNLLQDPDFNEINSTEENGWKASNGVTISEGGPFFKGRALQLASARENYPTYIYQKVDASTLKPYTRYKLDGFVQSSQDLEIDLIHHHKVHLVKNVPDNLVSDTYSDGSCSGINRCEEQHQVDVQLDAEDHPKDCCEAAQTHEFSSYIHTGDLNASVDQGIWVVLQVRTTDGYATLGNLELVEVGPLSGESLEREQRDNAKWNEEVGRKRAETDRIYQDAKQAINHLFVDYQDQQLSPEVGMADIIDAQNLIASISDVYSDAVLQIPGINYEMYTELSNRLQQASYLYTSRNVVQNGDFNSGLDSWNATTDTAVQQDGNMHFLVLSHWDAQVSQQFRVQPNCKYVLRVTAKKVGNGDGYVTIQDGAHHRETLTFNACDYDVNGTHVNDNSYITKELVFYPKTEHMWVEVSETEGTFYIDSIEFIETQE

SEQ ID NO: 512 - protein, 1150 aa, Bacillus thuringiensis B-Hm-16; identical to SEQ ID NO: 511

SEQ ID NO: 513 - protein, 1150 aa, Bacillus thuringiensis lyA
MNRNNPNEYEIIDAPYCGCPSDDDVRYPLASDPNAAFQNMNYKEYLQTYDGDYTGSLINPNLSINPRDVLQTGINIVGRILGFLGVPFAGQLVTFYTFLLNQLWPTNDNAVWEAFMAQIEELIDQKISAQVVRNALDDLTGLHDYYEEYLAALEEWLERPNGARANLVTQRFENLHTAFVTRMPSFGTGPGSQRDAVALLTVYAQAANLHLLLLKDAEIYGARWGLQQGQINLYFNAQQERTRIYTNHCVETYNRGLEDVRGTNTESWLNYHRFRREMTLMAMDLVALFPFYNVRQYPNGANPQLTREIYTDPIVYNPPANQGICRRWGNNPYNTFSELENAFIRPPHLFERLNRLTISRNRYTAPTTDSFLDYWSGHTLQSQHANNPTTYETSYGQITSNTRLFNTTNGARAIDSRARNFGNLYANLYGVSSLNIFPTGVMSEITNAANTCRQDLTTTEELPLENNNFNLLSHVTFLRFNTTQGGPLATLGFVPTYVWTREDVDFTNTITADRITQLPWVKASEIGGGTTVVKGPGFTGGDILRRTDGGAVGTIRANVNAPLTQQYRIRLRYASTTSFVVNLFVNNSAAGFTLPSTMAQNGSLTYESFNTLEVTHTIRFSQSDTTLRLNIFPSISGQEVYVDKLEIVPINPTREAEEDLEDAKKAVASLFTRTRDGLQVNVTDYQVDQAANLVSCLSDEQYGHDKKMLLEAVRAAKRLSRERNLLQDPDFNEINSTEENGWKASNGVTISEGGPFFKGRALQLASARENYPTYIYQKVDASTLKPYTRYKLDGFVQSSQDLEIDLIHHHKVHLVKNVPDNLVSDTYSDGSCSGINRCEEQHQVDVQLDAEDHPKDCCEAAQTHEFSSYIHTGDLNASVDQGIWVVLQVRTTDGYATLGNLELVEVGPLSGESLEREQRDNAKWNEEVGRKRAETDRIYQDAKQAINHLFVDYQDQQLSPEVGMADIIDAQNLIASISDVYSDAVLQIPGINYEMYTELSNRLQQASYLYTSRNVVQNGDFNSGLDSWNATTDTAVQQDGNMHFLVLSHWDAQVSQQFRVQPNCKYVLRVTAKKVGNGDGYVTIQDGAHHRETLTFNACDYDVNGTHVNDNSYITKELVFYPKTEHMWVEVSETEGTFYIDSIEFIETQE

SEQ ID NO: 514 - protein, 1150 aa, Bacillus thuringiensis ywc5-4
MNRNNPNEYEIIDAPYCGCPSDDDVRYPLASDPNAAFQNMNYKEYLQTYDGDYTGSLINPNLSINPRDVLQTGINIVGRILGFLGVPFAGQLVTFYTFLLNQLWPTNDNAVWEAFMAQIEELIDQKISAQVVRNALDDLTGLHDYYEEYLAALEEWLERPNGARANLVTQRFENLHTAFVTRMPSFGTGPGSQRDAVALLTVYAQAANLHLLLLKDAEIYGARWGLQQGQINLYFNAQQERTRIYTNHCVETYNRGLEDVRGTNTESWLNYHRFRREMTLMAMDLVALFPFYNVRQYPNGANPQLTREIYTDPIVYNPPANQGICRRWGNNPYNTFSELENAFIRPPHLFERLNRLTISRNRYTAPTTNSFLDYWSGHTLQSQHANNPTTYETSYGQITSNTRLFNTTNGARAIDSRARNFGNLYANLYGVSSLNIFPTGVMSEITNAANTCRQDLTTTEELPLENNNFNLLSHVTFLRFNTTQGGPLATLGFVPTYVWTREDVDFTNTITADRITQLPWVKASEIGGGTTVVKGPGFTGGDILRRTDGGAVGTIRANVNAPLTQQYRIRLRYASTTSFVVNLFVNNSAAGFTLPSTMAQNGSLTYESFNTLEVTHTIRFSQSDTTLRLNIFPSISGQEVYVDKLEIVPINPTREAEEDLEDAKKAVASLFTRTRDGLQVNVTDYQVDQAANLVSCLSDEQYGHDKKMLLEAVRAAKRLSRERNLLQDPDFNEINSTEENGWKASNGVTISEGGPFFKGRALQLASARENYPTYIYQKVDASTLKPYTRYKLGGFVQSSQDLEIDLIHHHKVHLVKNVPDNLVSGTYSDGSCSGINRCEEQHQVDVQLDAEDHPKDCCEAAQTHEFSSYIHTGDLNASVDQGIWVVLQVRTTDGYATLGNLELVEVGPLSGESLEREQRDNAKWNEEVGRKRAETDRIYQDAKQAINHLFVDYQDQQLSPEVGMADIIDAQNLIASISDVYSDAVLQIPGINYEMYTELSNRLQQASYLYTSRNVVQNGDFNSGLDSWNATTDTAVQQDGNMHFLVLSHWDAQVSQQFRVQPNCKYVLRVTAKKVGNGDGYVTIQDGAHHRETLTFNACDYDVNGTHVNDNSYITKELVFYPKTEHMWVEVSETEGTFYIDSIEFIETQE

SEQ ID NO: 515 - protein, 1150 aa, Bacillus thuringiensis
MNRNNPNEYDIIDAPYCGCPSDDDVRYPLASDPDAAFQNMNYKEYLQTYDGDYTGSLINPNLSINPRDVLQTGINIVGRILGFLGVPFAGQLVTFYTFLLNQLWPTNDNAVWEAFMAQIEELIDQKISAQVVRNALDDLTGLHDYYEEYLAALEEWLERPNGARANLVTQRFENLHTAFVTRMPSFGTGPGSQRDAVALLTVYAQAANLHLLLLKDAEIYGARWGLQQGQINLYFNAQQERTRIYTNHCVETYNRGLEDVRGTNTESWLNYHRFRREMTLMAMDLVALFPFYNVRQYPNGANPQLTREIYTDPIVYNPPANQGICRRWGNNPYNTFSELENAFIRPPHLFERLNRLTISRNRYTAPTTNSFLDYWSGHTLQSQHANNPTTYETSYGQITSNTRLFNTTNGARAIDSRARNFGNLYANLYGVSSLNIFPTGVMSEITNAANTCRQDLTTTEELPLENNNFNLLSHVTFLRFNTTQGGPLATLGFVPTYVWTREDVDFTNTITADRITQLPWVKASEIGGGTTVVKGPGFTGGDILRRTDGGAVGTIRANVNAPLTQQYRIRLRYASTTSFVVNLFVNNSAAGFTLPSTMAQNGSLTYESFNTLEVTHTIRFSQSDTTLRLNTSPSISGQEVYVDKLEIVPINPTREAEEDLEDAKKAVASLFTRTRDGLQVNVTDYQVDQAANLVSCLSDEQSGHDKKMLLEAVRAAKRLSRERNLLQDPDFNEINSTEENGWKASNGVTISEGGPFFKGRALQLASARENYPTYIYQKVDASTLKPYTRYKLDGFVQSSQDLEIDLIHHHKVHLVKNVPDNLVSDTHSDGSCSGINRCEEQHQVDVQLDAEDHPKDCCEAAQTHEFSSYIHTGDLNASVDQGIWVVLQVRTTDGYATLGNLELVEVGPLSGESLEREQRDNAKWNEEVGRKRAETDRIYQDAKQAINHLFVDYQDQQLSPEVGMADIIDAQNLIASISDVYSDAVLQIPGINYEMYTELSNRLQQASYLYTSRNVVQNGDFNSGLDSWNATTDTAVQQDGNMHFLVLSHWDAQVSQQFRVQPNCKYVLRVTAKKVGNGDGYVTIQDGAHHRETLTFNACDYDVNGTHVNDNSYITKELVFYPKTEHMWVEVSETEGTFYIDSIEFIETQE

SEQ ID NO: 516 - protein, 1150 aa, Bacillus thuringiensis 11
MNRNNPNEYEIIDAPYCGCPSDDDVRYPLASDPNAAFQNMNYKEYLQTYDGDYTGSLINPNLSINPRDVLQTGINIVGRILGFLGVPFAGQLVTFYTFLLNQLWPTNDNAVWEAFMAQIEELIDQKISAQVVRNALDDLTGLHDYYEEYLAALEEWLERPNGARANLVTQRFENLHTAFVTRMPSFGTGPGSQRDAVALLTVYAQAANLHLLLLKDAEIYGARWGLQQGQINLYFNAQQERTRIYTNHCVETYNRGLEDIRGTNTESWLNYHRFRREMTLMAMDLVALFPFYNVRQYPNGANPQLTREIYTDPIVYNPPANQGICRRWGNNPYNTFSELENAFIRPPHLFERLNRLTISRNRYTAPTTNSFLDYWPGHTLQSQHANNPTTYETSYGQITSNTRLFNTTNGARAIDSRARNFGNLYANLYGVSSLNIFPTGVMSEITNAANTCRQDLTTTEELPLENNNFNLLSHVTFLRFNTTQGGPLATLGFVPTYVWTREDVDFTNTITADRITQLPWVKASEIGGGTTVVKGPGFTGGDILRRTDGGAVGTIRANVNAPLTQQYRIRLRYASTTSFVVNLFVNNSAAGFTLPSTMAQNGSLTYESFNTLEVTHTIRFSQSDTTLRLNIFPSISGQEVYVDKLEIVPINPTREAEEDLEDAKKAVASLFTRTRDGLQVNVTDYQVDQAANLVSCLSDEQYGHDKKMLLEAVRAAKRLSRERNLLQDPDFNEINSTEENGWKASNGVTISEGGPFFKGRALQLASARENYPTYIYQKVDASTLKPYTRYKLDGFVQSSQDLEIDLIHHHKVHLVKNVPDNLVSDTYSDGSCSGINRCEEQHQVDVQLDAEDHPKDCCEAAQTHEFSSYIHTGDLNASVDQGIWVVLQVRTTDGYATLGNLELVEVGPLSGESLEREQRDNAKWNEEVGRKRAETDRIYQDAKRAINHLFVDYQDQQLSPEVGMADIIDAQNLIASISDVYSDAVLQIPGINYEMYTELSNRLQQASYLYTSRNVVQNGDFNSGLDSWNATTDTAVQQDGNMHFLVLSHWDAQVSQQFRVQPNCKYVLRVTAKKVGNGDGYVTIQDGAHHRETLTFNACDYDVNGTHVNDNSYITKELVFYPKTEHMWVEVSETEGTFYIDSIEFIETQE

SEQ ID NO: 517 - protein, 1150 aa, Bacillus thuringiensis 4
MNRNNPNEYEIIDASYCGCPSDDDVRYPLASDPNAAFQNMNYKEYLQTYDGDYTGSLINPNLSINPRDVLQTGINIVGRILGFLGVPFAGQLVTFYTFLLNQLWPTNDNAVWEAFMAQIEELIDQKISAQVVRNALDDLTGLHDYYEEYLAALEEWLERPNGARANLVTQRFENLHTAFVTRMPSFGTGPGSQRDAVALLTVYAQAANLHLLLLKDAEIYGARWGLQQGQINLYFNAQQERTRIYTNHCVETYNRGLEDVRGTNTESWLNYHRFRREMTLMAMDLVALFPFYNVRQYPNGANPQLTREIYTDPIVYNPPANQGICRRWGNNPYNTFSELENAFIRPPHLFERLNRLTISRNRYTAPTTNSFLDYWSGHTLQSQHANNPTTYETSYGQITSNTRLFNTTNGARAIDSRARNFGNLYANLYGVSSLNIFPTGVMSEITNAANTCRQDLTTTEELPLENNNFNLLSHVTFLRFNTTQGGPLATLGFVPTYVWTREDVDFTNTITADRITQLPWVKASEIGGGTTVVKGPGFTGGDILRRTDGGAVGTIRANVNAPLTQQYRIRLRYASTTSFVVNLFVNNSAAGFTLPSTMAQNGSLTYESFNTLEVTHTIRFSQSDTTLRLNIFPSISGQEVYVDKLEIVPINPTREAEEDLEDAKKAVASLFTRTRDGLQVNVTDYQVDQAANLVSWLSDEQYGHDKKMLLETVRAAKHLSRERNILLDPDFIEINSTEENGWKASNGVTIREGGPLFKGGALQLASARENYPTYIFQKVDASTLKPYTRYKLDGFVQSSQDLEIDLIHHHKVPLVKKVPDNLVFDTYFDGSCSGNNRCEGQHQVDVQLDAGGHPKGCCEAGQTHEFSSYIHTGDLNASVDQGIWVVLQVRTTDGYATLGNLELVEVGPLSGESLEREQRDNAKWNEEVGRKRAETDRIYQDAKQAINHLFVDYQDQQLSPEVGMADIIDAQNLIASISDVYSDAVLQIPGINYEMYTELSNRLQQASYLYTSRNVVQNGDFNSGLDSWNATTDTAVQQDGNMHFLVLSHWDAQVSQQFRVQPNCKYVLRVTAKKVGNGDGYVTIQDGAHHRETLTFNACDYDVNGTHVNDNSYITKELVFYPKTEHMWVEVSETEGTFYIDSIEFIETQE

SEQ ID NO: 518 - protein, 1152 aa, Bacillus thuringiensis
MNRNNQNDYEVIDASNCGCASDDVVQYPLARDPNAVFQNMHYKDYLQTYDGDYTGSFINPNLSINPRDVLQTGINIVGRLLGFLGVPFAGQLVTFYTFLLNQLWPTNDNAVWEAFMAQIEELINQRISEAVVGTAADHLTGLHDNYELYVEALEEWLERPNAARTNLLFNRFTTLDSLFTQFMPSFGTGPGSQNYAVPLLTVYAQAANLHLLLLKDAEIYGARWGLNQNQINSFHTRQQERTQYYTNHCVTTYNTGLDRLRGTNTESWLNYHRFRREMTLMAMDLVALFPYYNVRQYPNGANPQLTREIYTDPIVYNPPANQGICRRWGNNPYNTFSELENAFIRPPHLFDRLNRLTISRNRYTAPTTNSYLDYWSGHTLQSQYANNPTTYETSYGQITSNTRLFNTTNGANAIDSRARNFGNLYANLYGVSYLNIFPTGVMSEITSAPNTCWQDLTTTEELPLVNNNFNLLSHVTFLRFNTTQGGPLATVGFVPTYVWTRQDVDFNNIITPNRITQIPVVKAYELSSGATVVKGPGFTGGDVIRRTNTGGFGAIRVSVTGPLTQRYRIRFRYASTIDFDFFVTRGGTTINNFRFTRTMNRGQESRYESYRTVEFTTPFNFTQSQDIIRTSIQGLSGNGEVYLDRIEIIPVNPTREAEEDLEAAKKAVASLFTRTRDGLQVNVTDYQVDQAANLVSCLSDEQYAHDKKMLLEAVRAAKRLSRERNLLQDPDFNTINSTEENGWKASNGVTISEGGPFYKGRALQLASARENYPTYIYQKVDASELKPYTRYRLDGFVKSSQDLEIDLIHHHKVHLVKNVLDNLVSDTYPDDSCSGINRCEEQQMVNAQLETEHHHPMDCCEAAQTHEFSSYIDTGDLNSTVDQGIWVIFKVRTTDGYATLGNLELVEVGPLLGEPLEREQRENAKWNAELGRKRAETDRVYQDAKQSINHLFVDYQDQQLNPQIGMADIMDAQNLVASISDVYSDAVLQIPGINYEIYTELSNRLQQASYLYTSRNAVQNGDFNNGLDSWNATAGASVQQDGNTHFLVLSHWDAQVSQQFRVQPNCKYVLRVTAEKVGGGDGYVTIRDGAHHTETLTFNACDYDINGTYVTDNTYLTKEVIFYSHTEHMWVEVNETEGAFHIDSIEFVETEK

SEQ ID NO: 519 - protein, 1154 aa, Bacillus thuringiensis kurstaki DP1019
MNRNNQNEYEIIDGTNCDCSSDEVVKYPLASEQNGVLQNMNYKEYLQTYDGDYTGSLINPNLSINTRDVLQTGITIVGRVLGFLGVPFAGQLVTFYTFLLNQLWPTNNNAVWEAFMAQVEELIDQRISDQVVRNALDDLTGLHDYYNEYLAALEEWLDRPNGARANLAFQRFENLHTAFVTRMPSFGTGPGSQRDAVALLTVYAQAANLHLLLLKDAEIYGARWGLQQSQINLYFNAQQDRTRIYTNHCVATYNRGLEDLKGTNTESWYNYHQFRREMTLMAMDLVALFPYYNVRQYPNGANPQLTREIYTDPVVFNPPANQGLCRRWGNNPYMTFSGLENAFIRPPHLFDRLNSLTINSHRFPISSNFMDYWAGHTLRRSYMNNSAVQEDSYGAITPTRVTINPGVNGTNHIESTAVDFRSGLVGIYGVHRASFVPGGLFNGTISPANAGCRNLHDTRDVLPLEENNGSPSHRLSHVTFLSFQTNQAGSLANGGSVPLYVWARQDIDFNNTITANRITQLPLVKAFEIAAGTTIVKGPGFTGGDILRRTSTGTLGTIRVNVNSPLTQRYRVRFRYASTVDFDFFVSRGGTTVNNFRFPRTMSRGQESRYESYVTSEFTTPFTFTQSQDFIRTSIQGLSGNGEVYLDRIEIIPVNPAREAEEDLEAAKKAVASLFTRTRDGLQVNVTDYQVDQAANLVSCLSDEQYGHDKKMLLEAVRAAKRLSRERNLLQDPDFNEINSIEENGWKASNGVTISEGGPFFKGRALQLASARENYPTYIYQKVDASVLKPYTRYRLDGFVKSSQDLEIDLIHHHKVHLVKNVPDNLVSDTYSDGSCSGINRCDEQHQVDMQLDAEHHPMDCCEAAETHEFSSYIDTGDLNPSVDQGIWVVLKVRTTDGYATLGNLELVEVGSLSGESLEREKRENAEWNAELGRKRAETERVYQAAKRAINHLFVDYQDQQLNLEVGLAEINEVSNLVESIPSVYSDTVLQIPGVNYEIYTELSNRLQQASYLYMSRNAVQNGDFNNGLDSWNATTDATVQQDGTMHFLVLSHWDAQVSQPLRVQPNCKYVLRVTARKVGSGDGYVTIRNGAHHHETLIFNACDYDINGTYVNENTYITKEVVFYPHTEHTWVEVSESEGAFYIDSIELIETQE

SEQ ID NO: 520 - protein, 249 aa, Bacillus thuringiensis israelensis
MENLNHCPLEDIKVNPWKTPQSTARVITLRVEDPNEINNLLSINEIDNPNYILQAIMLANAFQNALVPTSTDFGDALRFSMPKGLEIANTITPMGAVVSYVDQNVTQTNNQVSVMINKVLEVLKTVLGVALSGSVIDQLTAAVTNTFTNLNTQKNEAWIFWGKETANQTNYTYNVLFAIQNAQTGGVMYCVPVGFEIKVSAVKEQVLFFTIQDSASYNVNIQSLKFAQPLVSSSQYPIADLTSAINGTL

SEQ ID NO: 521 - protein, 249 aa, Bacillus thuringiensis israelensis; identical to SEQ ID NO: 520

SEQ ID NO: 522 - protein, 249 aa, Bacillus thuringiensis LLP29
MENLNHCPLEDIKVNPWKTPQSKARVITLRVEDPNEINNLLSINEIDNPNYILQAIMLANAFQNALVPTSTDFGDALRFSMPKGLEIANTITPMGAVVSYVDQNVTQTNNQVSVMINKVLEVLKTVLGVALSGSVIDQLTAAVTNTFTNLNTQKNEAWIFWGKETANQTNYTYNVLFAIQNAQTGGVMYCVPVGFEIKVSAVKEQVLFFTIQDSASYNVNIQSLKFAQPLVSSSQYPIADLTSAINGTL

SEQ ID NO: 523 - protein, 131 aa, Bacillus thuringiensis LDC-9
MFFLLTKLIISNYILQAIMLANAFQNALVPTSTDFGDALRFSMPKGLEIANTITPMGAVVSYVDQNVTQTNNQVSVMINKVLEVLKTVLGVALSGSVIDQLTAAVTNTFTNLNTQKNEAWICWGKETANQT

SEQ ID NO: 524 - protein, 252 aa, Bacillus thuringiensis s. israelensis IPS82
MHLNNLNNFNNLENNGEYHCSGPIIKKPFRHIALTVPSSDITNFNEIFYVEPQYIAQAIRLTNTFQGAIDPLTLNFNFEKALQIANGLPNAGVTGTINQSVIHQTIEVSVMISQIKEIIRSVLGLVINSANFWNSVVSAITNTFTNLEPQVDENWIVWRNLSATQTSYFYKILFSIQNEDTGRFMAILPIAFEITVDVQKQQLLFITIKDSARYEVKMKALTVVQALDSYNAPIIDVFNVRNYSLHRPNHNI

SEQ ID NO: 525 - protein, 262 aa, Bacillus thuringiensis LLP29
MHLNNLNNFNNLENNGEYHCSAPIIKKPFRHIALTVPSSDITNFNEIFYVEPQYIAQAIRLTNTFQGAIDPLTLNFNFEKALQIANGLPNAGVTGTINQSVIHQTIEVSVMISQIKEIIRSVLGLVINSANFWNSVVSAITNTFTNLEPQVDENWIVWRNLSATQTSYFYKILFSIQNEDTGRFMAILPIAFEITVDVQKQQLLFITIKDSARYEVKMKALTVVQALDSYNAPIIDVFNVRNYSLHRPNHNILQNLNVNPIK

SEQ ID NO: 526 - protein, 156 aa, Bacillus thuringiensis israelensis PG14
NTFQGAIDPLTLNFNFEKALQIANGLPNAGVTGTINQSVIHQTIEVSVMISQIKEIIRSVLGLVINSANFWNRVVSAITNTFTNLEPQVDENWIVWRNLSATQTSYFYKILFSIQNEDTGRFMAILPIAFEITVDVQKQQLLFITIKDSARYEVKM

SEQ ID NO: 527 - protein, 156 aa, Bacillus thuringiensis morrisoni HD12
NTFQGAIDPLTLNFNFEKALQIANGLPNAGVTGTINQSVIHQTIEVSVMISQIKEIIRSVLGLVINSANFWNSVVSAITNTFTNLEPQVDENWIVWRNLSATQTSYFYKILFSIQNEDTGRFMAILPIAFEITVDVQKQQLLFITIKDSARYEVKM

SEQ ID NO: 528 - protein, 157 aa, Bacillus thuringiensis tenebrionis
NTFQGAIDPLTLNFNFEKALQIANGLPNAGVTGTINQSVIHQTIEVSVMISQIKEIIRSVLGLVINSANFWNSVVSAITNTFTNLEPQVDENWIVWRNLSATQTSYFYKILFSIQNEDTGRFMAILPIAFEITVDVQKQQLLFITIKDSARYEVKMK

SEQ ID NO: 529 - protein, 263 aa, Bacillus thuringiensis T36
MHLNNLNNFNNLENNGEYHRSGPIIKKPFRHIALTVPSSDITNFNEIFYVEPQYIAQAIRLTNTFQGAIDPLTLNFNFEKALQIANGLPNAGVTGTIIQSVIHQTIEVSVMISQIKEIIRSVLGLVINSANFWNSVVSAITNTFTNLEPQVDENWIVWRNLSATQTSYFYKILFSIQNEDTGRFMAILPIAFEITVDVQKQQLLFITIKDSARYEVKMKALTVVQALDSYNAPIIDVFNVRNYSLHRPNHNILQNLNVNPIKS

SEQ ID NO: 530 - protein, 119 aa, Bacillus thuringiensis LDC-9
LQIANGIPNAGVTGTINQSVIHQTIEVSVMISQIKEIIRSVLGLVINSANFWNSVVSAITNTFTNLEPQVDENWIVWRNLSATQTSYFYKILFSIQNEDTGRFMAILPIAFEITVDVGK

SEQ ID NO: 531 - protein, 260 aa, Bacillus thuringiensis medellin
MYINNFDFPEKNNDYQCSGPIIKKPFRHIALTVPSSDITNFNEIFYVEPQYIAQALRLTNTFQGAIDPLTLNFNFEKALQIANGLPNAGVTGTLNQSVIHQTIEISVMISQIKEIIRSVLGLVINSANFWNNVVSAITNTFTNLEPQVDENWIVWRNLSANQTSYYYKILFSIQNEDTGRFMAVLPIAFEINVDVHKQQLLFITIKDSARYEVKMKALTVVQALDSYNAPIIDVFNIHNYSLHRPNYHILQNLNVNPIKS

SEQ ID NO: 532 - protein, 138 aa, Bacillus thuringiensis serovar darmstadiensis
QIANGIPNAGVTGTINQSVIHQTIEVSVMISQIKEIIRSVLGLVINSANFWNSVVSAITNTFTNLEPQVDENWIVWRNLSATQTSYFYKILFSIQNEDTGRFMAILPIAFEITVDVQKQQLLFITIKDSARYAVTMKA

SEQ ID NO: 533 - protein, 231 aa, Bacillus thuringiensis
MFFNRVITLTVPSSDVVNYSEIYQVAPQYVNQALTLAKYFQGAIDGSTLRFDFEKALQIANDIPQAAVVNTLNQTVQQGTVQVSVMIDKIVDIMKNVLSIVIDNKKFWDQVTAAITNTFTNLNSQESERWIFYYKEDAHKTSYYYNILFAIQDEETGGVMATLPIAFDISVDIEKEKVLFVTIKDTENYAVTVKAINVVQALQSSRDSKVVDAFKSPRHLPRKRHKICSNS

SEQ ID NO: 534 - protein, 41 aa, Atrax robustus
GSQYCAPADQPCSLNTQPCCDDVTCTQERNENGHTAYYCRV

SEQ ID NO: 535 - protein, 98 aa, Hadronyche versuta
MKFSKLSLTLALILTQALFVLCGKINEDFMKNGLESQTLHDEIRKPIDSENPDTERLLDCLLDNRVCSSDRDCCGMTPSCTMGLCVPNVGGLVGGILG

SEQ ID NO: 536 - protein, 98 aa, Atrax robustus; identical to SEQ ID NO: 535

SEQ ID NO: 537 - protein, 98 aa, Hadronyche versuta
MKFSKLSLTLALILTQAIFVLCGKINEDFMKNDLESQALRDEIRKPIDSENPDTERLLDCLLDNRVCSSDKDCCGMTPSCTMGLCVPSVGGLVGGILG

SEQ ID NO: 538 - protein, 98 aa, Hadronyche versuta
MKFSKLSLTLALILTQAIFVLCGKINEDFMKNDLESHALHDEIRKPINSENPDTERLLDCLLDNRVCSSDKDCCGMTPSCTMGLCVPSVGGLVGGILG

SEQ ID NO: 539 - protein, 98 aa, Hadronyche versuta
MKFSKLSLTLALILTQALFVLCGKINEDFMKNGLESQALHDEIRKPIDSENPDTERLLDCLLDNRVCSSDKDCCGMTPSCTMGLCVPSVGGLVGGILG

SEQ ID NO: 540 - protein, 98 aa, Hadronyche versuta
MKFSKLSLTLALILTQVIFVLCGKINEDFMKNGLESQALHDEIRKPIDSENPDTERLLDCLLDNRVCSSDKDCCGMTPSCTMGLCVPSVGGLVGGILG

SEQ ID NO: 541 - protein, 93 aa, Hadronyche versuta
MKFSKLSLTLALILTQALFVLCDFMKNGLESQALHDEIRKSIDSENPDTERLLDCLLDNRVCSSDKDCCGMTPSCTMGLCVPSVGGLVGGILG

SEQ ID NO: 542 - protein, 98 aa, Atrax robustus
MKFSKLSLTLALILTQVLFVLCGKINEDFMKHGLESQALHDEIRKPIDSENPDTERLLDCLLDNRVCSSDKDCCGMTPSCTMGLCVPSVGGLVGGILG

SEQ ID NO: 543 - protein, 98 aa, Hadronyche versuta
MKFSKLSLTLALILTQAIFVLCGKINEDFMKNDLESQALHDEIRKPINSENPDTERLLDCLLDNRVCSSDKDCCGMTPSCTMGLCVPSVGGLVGGILG

SEQ ID NO: 544 - protein, 98 aa, Hadronyche versuta
MKFSKLSLTLALILTQALFVLCGKINEDFMKNGLESQALHDEIRKPIDSENPDTERLLDCLLDNRVCSSDRDCCGMTPSCTMGLCVPNVGGLVGDILG

SEQ ID NO: 545 - protein, 97 aa, Hadronyche versuta
MKFSKLSLTLALILTQVLFVLCGKIEDFMKNGLESQALHDEIRKPIDSENPDTERLLDCLLDNRVCSSDKDCCGMTPSCTMGLCVPNVGGLVGGILG

SEQ ID NO: 546 - protein, 93 aa, Hadronyche versuta
MKFSKLSLTLALILTQALFVLCDFMKNGLESQALHDEIRKPIDSENPDTERLLDCLLDNRVCSSDKDCCGMTPSCTMGLCVPNVGGLVGGILG

SEQ ID NO: 547 - protein, 98 aa, Hadronyche versuta
MKFSKLSLTLALILTQALFVLCGKINEDFMKNGLESQALHDEIRKPIDSENPDTERLLDCLLDNRICSSDKDCCGMTPSCTMGLCVPNVGGLVGGILG

SEQ ID NO: 548 - protein, 98 aa, Hadronyche versuta
MKFSKLSLTLALILTQALFVLCGKINEDFMKNGLESQALHDEIRKPIDSENPDTERLLDCLLDNRVCSSDKDCCGMTPSCTMGLCVPNVGGLVGGILG

SEQ ID NO: 549 - protein, 98 aa, Hadronyche versuta
MKFSKLSLTLALILTQAIFVLCGKINEDFMKNDLESQALHDEIRKPINSENPDTERLLDCLLDSRVCSSDKDCCGMTPSCTMGLCVPSVGGLVGGILG

SEQ ID NO: 550 - protein, 96 aa, Atrax robustus
MKFSKLSITLAVILTQAVFVFCGMTNEDFMEKGLESNELPDAIKKPVNSGKPDTKRLLDCVLSRMCFSNANCCGLTPPCKMGLCVPNVGGLLGGIL

SEQ ID NO: 551 - protein, 96 aa, Atrax robustus
MKFSKLSITLAVILTQAVFVFCGMTNEDFMEKGLESNELHDAIKKPVNSGKPDTERLLDCVLSRMCSSDANCCGLTPTCKMGLCVPNVGGLLGGIL

SEQ ID NO: 552 - protein, 101 aa, Hadronyche versuta
MKFSKLSLTLALILTQALFVLCGKINEDFMEHGLESHALHDEIRKPIDTEKADAERLVDCVVNTLGCSSDKDCCGMTPSCTLGICAPSVRGLVGGLLGRAL

SEQ ID NO: 553 - protein, 101 aa, Hadronyche versuta
MKFSKLSLTLALILTQALFVLCMKINEDFMENGLESHALHDEIRKPIDTEKADAERLVDCVVNTLGCSSDKDCCGMTPSCTLGICAPSVGGLVGGLLGRAL

SEQ ID NO: 554 - protein, 101 aa, Hadronyche versuta
MKFSKLSLTFALILTQALFVLCGKINEDFMDNGLESHALHDEIRKPIHTEKADAERLVDCVLNTLGCSSDKDCCGMTPSCTLGICAPSVGGLVGGLLGRAL

SEQ ID NO: 555 - protein, 101 aa, Hadronyche infensa
MKFSKLSLTLALILTQALFVLCGKINEDFMEHGLESHALHDEIRKPIDTEKADAERLVDCVVNTLGCSSDKDCCGMTPSCTLGICAPSVGGLVGGLLGRAL

SEQ ID NO: 556 - protein, 101 aa, Hadronyche infensa
MKFSKLSVTLALILTQTLLVLCGKINEDFMENGLESHALHDEIRKPIDTDKAYAERVLDCVVNTLGCSSDKDCCGMTPSCTLGICAPSVGGLVGGLLGRAL

SEQ ID NO: 557 - protein, 101 aa, Hadronyche versuta
MKFSKLSLTLALILTQALFVLCGKINEDFMENGLESHALHDEIRKPIDTEKADAERLVDCVVNTLGCSSDKDCCGMTPSCTLGICAPSVGGLVGGLLGRAL

SEQ ID NO: 558 - protein, 101 aa, Hadronyche versuta
MKFSKLSLTLALILTQALFVLCGKINEDFMENGLESHALHDEIRKPIDTEKADAERVLDCVVNTLGCSSDKDCCGMTPSCTLGICAPSVGGLVGGLLGRAL

SEQ ID NO: 559 - protein, 100 aa, Hadronyche versuta
MKFSKLSLTLALILTQALFVLCGKINEDFMENGLESHALHDEIRKPIDTEKADAERLVDCVVNTLGCSSDKDCCGMTPSCTLGICAPSVGLVGGLLGRAL

SEQ ID NO: 560 - protein, 97 aa, Atrax robustus
MKFSKLSITLAVILTQAVFVFCGMTNEDFMEKGFKSNDLQYAIKQPVNSGKPDTERLLDCVLSRVCSSDENCCGLTPTCTMGLCVPNVGGLLGGLLS

SEQ ID NO: 561 - protein, 97 aa, Atrax robustus
MKFSKLSITLVVILTQAVFVFCGMTNEDFMEKGFKSNDLQYAIRQPVNSGKPDTERLLDCVLSRVCSSDENCCGLTPTCTMGLCVPNVGGLLGGLLS

SEQ ID NO: 562 - protein, 101 aa, Hadronyche versuta
MKFSKLSLTLALILTQALLVLCGKINEDFMENGLESHALHDEIRKPLDTENPDTERQLDCVLNTLGCSSDKDCCGMTPSCTLGICAPNVGGLVGGLLGRAL

SEQ ID NO: 563 - protein, 101 aa, Hadronyche versuta
MKFSKLSLTLALILTQVLLVVCGKINEDFMENGLESHALHDEIRKPIDTEKADAERVLDCVVNTLGCSSDKDCCGMTPSCTLGICAPSVGGIVGGLLGRAL

SEQ ID NO: 564 - protein, 101 aa, Hadronyche versuta
MKFSKLSLTLALILAQAIFVLCGKINEDFMENGLESHALHDEIRKPIDTEKADAERVVDCVLNTLGCSSDKDCCGMTPSCTLGICAPSVGGLVGGLLGRAL

SEQ ID NO: 565 - protein, 101 aa, Hadronyche versuta
MKFSKLSLTLALILTQALLVVCGKINEDFMENGLESHALHDEIRKPIDTEKADAERVLDCVVNILGCSSDKDCCGMTPSCTLGICAPSVGGIVGGLLGRAL

SEQ ID NO: 566 - protein, 101 aa, Hadronyche versuta
MKFSKLSLTLALILTQALLVVCGKINEDFMENGLESHALHDEIRKPIDTEKADAERVLDCVVNTLGCSSDKDCCGMTPSCTLGICAPSVGGIVGGLLGRAL

SEQ ID NO: 567 - protein, 101 aa, Hadronyche infensa
MKFSKLSLTLALILTQALLVVCGKINEDFMENGLESHALHDEIRKSIDTEKADAERVLDCVVNTLGCSSDKDCCGMTPSCTLGICAPSVGGIVGGLLGRAL

SEQ ID NO: 568 - protein, 95 aa, Hadronyche versuta
MKFSKLSLTFALILTQTLLVLCDFMENGLESHALHDEIRKPIDTEKADAERVLDCVVNTLGCSSDKDCCGMTPSCTLGICAPSVGGLVGGLLGRA

SEQ ID NO: 569 - protein, 76 aa, Hadronyche versuta
MNTATGFIVLLVLATVLGGVEAGESHMRKDAMGRVRRQYCVPVDQPCSLNTQPCCDDATCTQERNENGHTVYYCRA

SEQ ID NO: 570 - protein, 39 aa, Hadronyche versuta; identical to SEQ ID NO: 12

SEQ ID NO: 571 - protein, 39 aa, Hadronyche versuta
GSCVPVDQPCSLNTQPCCDDATCTQERNENGHTVYYCRA

SEQ ID NO: 572 - protein, 75 aa, Hadronyche versuta
MNTATGFIVLLVLATILGGIEAGESHMRKDAMGRVRRQYCVPVDQPCSLNTQPCCDDATCTQERNENGHTVYYCR

SEQ ID NO: 573 - protein, 38 aa, Hadronyche versuta
QYCVPVDQPCSLNTQPCCDDATCTQERNENGHTVYYCR

SEQ ID NO: 574 - protein, 75 aa, Hadronyche versuta
MNTATGFIVLLVLATVLGGIEAGESHMRKDAMGRVRRQYCVPVDQPCSLNTQPCCDDATCTQELNENDNTVYYCR

SEQ ID NO: 575 - protein, 38 aa, Hadronyche versuta
QYCVPVDQPCSLNTQPCCDDATCTQELNENDNTVYYCR

SEQ ID NO: 576 - protein, 76 aa, Hadronyche versuta
MNTATGFIVLLVLATILGGIEAGESHMRKDAMGRVRRQYCVPVDQPCSLNTQPCCDDATCTQERNENGHTVYYCRA

SEQ ID NO: 577 - protein, 39 aa, Hadronyche versuta; identical to SEQ ID NO: 12

SEQ ID NO: 578 - protein, 76 aa, Hadronyche versuta
MNTATGFIVLLVLATVLGGIEAGESHMRKDAMGRVRRQYCVPVDQPCSLNTQPCCDDATCTQELNENANPVYYCRA

SEQ ID NO: 579 - protein, 39 aa, Hadronyche versuta; identical to SEQ ID NO: 6

SEQ ID NO: 580 - protein, 76 aa, Hadronyche versuta
MNTTTGFIVLLVLATILGGIEAGESHMRKDAMGRVRRQYCVPVDQPCSLNTQPCCDDATCTQELNENDNTVYYCRA

SEQ ID NO: 581 - protein, 39 aa, Hadronyche versuta
QYCVPVDQPCSLNTQPCCDDATCTQELNENDNTVYYCRA

SEQ ID NO: 582 - protein, 76 aa, Hadronyche versuta
MNTATGFIVLLVLATVLGGIEAGESHMRKDAMGRVRRQYCVPVDQPCSLNTQPCCDDATCTQELNENDNTVYYCRA

SEQ ID NO: 583 - protein, 39 aa, Hadronyche versuta; identical to SEQ ID NO: 581

SEQ ID NO: 584 - protein, 76 aa, Hadronyche versuta
MNTATGFIVFLVLATVLGGIEAGESHMRKDAMGRVRRQYCVPVDQPCSLNTQPCCDDATCTQELNENDNTVYYCRA

SEQ ID NO: 585 - protein, 39 aa, Hadronyche versuta; identical to SEQ ID NO: 581

SEQ ID NO: 586 - protein, 76 aa, Hadronyche versuta
MNTATGFIVLLVLATVLGGIEARESHMRKDAMGRVRRQYCVPVDQPCSLNTQPCCDDATCTQELNENDNTVYYCRA

SEQ ID NO: 587 - protein, 39 aa, Hadronyche versuta; identical to SEQ ID NO: 581

SEQ ID NO: 588 - protein, 37 aa, Hadronyche versuta; identical to SEQ ID NO: 24

SEQ ID NO: 589 - protein, 45 aa, Hadronyche versuta
LLACLFGNGRCSSNRDCCELTPVCKRGSCVSSGPGLVGGILGGIL

SEQ ID NO: 590 - protein, 19 aa, Hadronyche versuta
EDTRADLQGGEAAEKVFRR

SEQ ID NO: 591 - protein, 15 aa, Hadronyche versuta
GESHVREDAMGRARR

SEQ ID NO: 592 - protein, 78 aa, Atrax robustus
MNTATGVIALLVLATVIGCIEAEDTRADLQGGEAAEKVFRRSPTCIPSGQPCPYNENCCSQSCTFKENENGNTVKRCD

SEQ ID NO: 593 - protein, 37 aa, Atrax robustus; identical to SEQ ID NO: 24

SEQ ID NO: 594 - protein, 78 aa, Atrax robustus
MNTATGVIALLVLVTVIGCIEAEDTRADLQGGEAAEKVFRRSPTCIPSGQPCPYNENCCSQSCTFKENENGNTVKRCD

SEQ ID NO: 595 - protein, 37 aa, Atrax robustus; identical to SEQ ID NO: 24

SEQ ID NO: 596 - protein, 78 aa, Atrax robustus
MNTATGVIALLVLATVIGCIEAEDTRADLQGGEAAEKVFRRSPTCIPSGQPCPYNENCCSQSCTFKENETGNTVKRCD

SEQ ID NO: 597 - protein, 37 aa, Atrax robustus
SPTCIPSGQPCPYNENCCSQSCTFKENETGNTVKRCD

SEQ ID NO: 598 - protein, 78 aa, Atrax robustus
MNTATGVIALLVLATVIGCIEAEDTRADLQGGEAAEKVFRRSPTCIPSGQPCPYNENCCSQSCTFKENENANTVKRCD

SEQ ID NO: 599 - protein, 37 aa, Atrax robustus
SPTCIPSGQPCPYNENCCSQSCTFKENENANTVKRCD

SEQ ID NO: 600 - protein, 78 aa, Atrax robustus
MNTATGVIALLVLATVIGCIEAEDTRADLQGGEAAEKVFRRSPTCIPSGQPCPYNENCCSKSCTYKENENGNTVQRCD

SEQ ID NO: 601 - protein, 37 aa, Atrax robustus
SPTCIPSGQPCPYNENCCSKSCTYKENENGNTVQRCD

SEQ ID NO: 602 - protein, 73 aa, Atrax robustus
MNTATGFIVLLVLATVLGCIEAGESHVREDAMGRARRGACTPTGQPCPYNESCCSGSCQEQLNENGHTVKRCV

SEQ ID NO: 603 - protein, 36 aa, Atrax robustus
GACTPTGQPCPYNESCCSGSCQEQLNENGHTVKRCV

SEQ ID NO: 604 - protein, 79 aa, Hadronyche versuta
MNTATGFIVLLVLATVIGCISADFQGGFEPYEGEDAERIFRRSPTCIPTGQPCPYNENCCSQSCTYKANENGNQVKGCD

SEQ ID NO: 605 - protein, 37 aa, Hadronyche versuta
SPTCIPTGQPCPYNENCCSQSCTYKANENGNQVKGCD

SEQ ID NO: 606 - protein, 79 aa, Hadronyche versuta
MNTATGFIVLLVLATVIGCISADFQGGFEPYEEEDAERIFRRSPTCIPTGQPCPYNENCCNQSCTYKANENGNQVKRCD

SEQ ID NO: 607 - protein, 37 aa, Hadronyche versuta
SPTCIPTGQPCPYNENCCNQSCTYKANENGNQVKRCD

SEQ ID NO: 608 - protein, 79 aa, Hadronyche versuta
MNTATGFIVLLVLATVIGCISADFQGGFEPYEEEDAERIFRRSPTCIPTGQPCPYNENCCSQSCTYKANENGNQVKRCD

SEQ ID NO: 609 - protein, 37 aa, Hadronyche versuta
SPTCIPTGQPCPYNENCCSQSCTYKANENGNQVKRCD

SEQ ID NO: 610 - protein, 79 aa, Hadronyche versuta
MNTATGFIVLLVLATVIGCISVDFQGGFESYEEEDAERIFRRSPTCIPTGQPCPYNENCCSQSCTYKANENGNQVKRCD

SEQ ID NO: 611 - protein, 37 aa, Hadronyche versuta; identical to SEQ ID NO: 609

SEQ ID NO: 612 - protein, 78 aa, Hadronyche versuta
MNTATGFIVLLVLATVIGCISADFQGGFESSVEDAERLFRRSSTCIRTDQPCPYNESCCSGSCTYKANENGNQVKRCD

SEQ ID NO: 613 - protein, 37 aa, Hadronyche versuta
SSTCIRTDQPCPYNESCCSGSCTYKANENGNQVKRCD

SEQ ID NO: 614 - protein, 78 aa, Hadronyche versuta
MNTATGFIVLLVLATVIGCISADFQGGFEPYEEEDAERIFRRSTCTPTDQPCPYHESCCSGSCTYKANENGNQVKRCD

SEQ ID NO: 615 - protein, 36 aa, Hadronyche versuta
STCTPTDQPCPYHESCCSGSCTYKANENGNQVKRCD

SEQ ID NO: 616 - protein, 78 aa, Hadronyche versuta
MNTATGFIVLLVLATVIGCISADFEGSFEPYEEEDAERIFRRSTCTPTDQPCPYDESCCSGSCTYKANENGNQVKRCD

SEQ ID NO: 617 - protein, 36 aa, Hadronyche versuta
STCTPTDQPCPYDESCCSGSCTYKANENGNQVKRCD

SEQ ID NO: 618 - protein, 78 aa, Hadronyche versuta
MNTATGFIVLLVLATVIGCISADFQGSFEPYEEEDAERIFRRSTCTPTDQPCPYDESCCSGSCTYKANENGNQVKRCD

SEQ ID NO: 619 - protein, 36 aa, Hadronyche versuta; identical to SEQ ID NO: 617

SEQ ID NO: 620 - protein, 78 aa, Hadronyche versuta
MNTATGFIVLLVLATVIGCISADFQGSFEPYEEEDAERIFRRSTCTPTDQPCPYHESCCSGSCTYKANENGNQVKRCD

SEQ ID NO: 621 - protein, 36 aa, Hadronyche versuta; identical to SEQ ID NO: 615

SEQ ID NO: 622 - protein, 78 aa, Hadronyche versuta
MNTATGFIVLLVLATVIGCISADFQGGFEPYEEEDAERIFRRSTCTPTDQPCPYDESCCSGSCTYKANENGNQVKRCD

SEQ ID NO: 623 - protein, 36 aa, Hadronyche versuta; identical to SEQ ID NO: 617

SEQ ID NO: 624 - protein, 36 aa, Atrax infensus; identical to SEQ ID NO: 615

SEQ ID NO: 625 - protein, 37 aa, Atrax infensus; identical to SEQ ID NO: 609

SEQ ID NO: 626 - protein, 37 aa, Atrax infensus; identical to SEQ ID NO: 613

SEQ ID NO: 627 - protein, 37 aa, Atrax robustus
SSVCIPSGQPCPYNEHCCSGSCTYKENENGNTVQRCD

SEQ ID NO: 628 - protein, 37 aa, Hadronyche versuta; identical to SEQ ID NO: 24

SEQ ID NO: 629 - protein, 37 aa, Atrax formidabillis
SPTCTGADRPCAACCPCCPGTSCKGPEPNGVSYCRND

SEQ ID NO: 630 - protein, 36 aa, Atrax formidabillis
SPTCTGADRPCAACCPCCPGTSCKGPEPNGVSYCRN

SEQ ID NO: 631 - protein, 37 aa, Atrax formidabillis
SPTCIRSGQPCPYNENCCSQSCTFKTNENGNTVKRCD

SEQ ID NO: 632 - protein, 9 aa, Atrax infensus
NGNQVKRCD

SEQ ID NO: 633 - protein, 9 aa, Atrax infensus
NGNQVKRCD

SEQ ID NO: 634 - protein, 9 aa, Hadronyche versutus
NGNTVKRCD

SEQ ID NO: 635 - protein, 15 aa, Hadronyche versutus
SPTCIPSGQPCPYNE

SEQ ID NO: 636 - protein, 16 aa, Agelenopsis aperta
ECVPENGHCRDWYDEC

SEQ ID NO: 637 - protein, 37 aa, Agelenopsis aperta
ECATKNKRCADWAGPWCCDGLYCSCRSYPGCMCRPSS

SEQ ID NO: 638 - protein, 38 aa, Agelenopsis aperta
ADCVGDGQRCADWAGPYCCSGYYCSCRSMPYCRCRSDS

SEQ ID NO: 639 - protein, 37 aa, Agelenopsis aperta
ACVGENQQCADWAGPHCCDGYYCTCRYFPKCICRNNN

SEQ ID NO: 640 - protein, 37 aa, Agelenopsis aperta
ACVGENKQCADWAGPHCCDGYYCTCRYFPKCICRNNN

SEQ ID NO: 641 - protein, 37 aa, Agelenopsis aperta
DCVGESQQCADWAGPHCCDGYYCTCRYFPKCICVNNN

SEQ ID NO: 642 - protein, 36 aa, Hololena curta
SCVGEYGRCRSAYEDCCDGYYCNCSQPPYCLCRNNN

SEQ ID NO: 643 - protein, 38 aa, Hololena curta
ADCVGDGQKCADWFGPYCCSGYYCSCRSMPYCRCRSDS

SEQ ID NO: 644 - protein, 70 aa, Androctonus australis Hector
KKNGYAVDSSGKAPECLLSNYCNNQCTKVHYADKGYCCLLSCYCFGLNDDKKVLEISDTRKSYCDTTIIN

SEQ ID NO: 645 - protein, 70 aa, Androctonus australis Hector
KKNGYAVDSSGKAPECLLSNYCNNECTKVHYADKGYCCLLSCYCFGLNDDKKVLEISDTRKSYCDTTIIN

SEQ ID NO: 646 - protein, 70 aa, Androctonus australis Hector
KKDGYAVDSSGKAPECLLSNYCYNECTKVHYADKGYCCLLSCYCFGLNDDKKVLEISDTRKSYCDTPIIN

SEQ ID NO: 647 - protein, 33 aa, Scorpio maurus palmatus
ALPLSGEYEPCVRPRKCKPGLVCNKQQICVDPK

SEQ ID NO: 648 - protein, 61 aa, Leiurus quinquestriatus
DGYIRKRDGCKLSCLFGNEGCNKECKSYGGSYGYCWTWGLACWCEGLPDEKTWKSETNTCG

SEQ ID NO: 649 - protein, 61 aa, Buthotus judaicus
DGYIRKKDGCKVSCIIGNEGCRKECVAHGGSFGYCWTWGLACWCENLPDAVTWKSSTNTCG

SEQ ID NO: 650 - protein, 39 aa, Atrax robustus
GSSPTCIPSGQPCPYNENCCSQSCTFKENENGNTVKRCD

SEQ ID NO: 651 - protein, 39 aa, Atrax robustus
GSAICTGADRPCAACCPCCPGTSCKAESNGVSYCRKDEP

SEQ ID NO: 652 - protein, 41 aa, Atrax robustus; identical to SEQ ID NO: 5

SEQ ID NO: 653 - protein, 60 aa, Hadronyche versuta
MNTATGFIVLLVLATVLGGVEAGESHMRKDAMGRVRRQYCVPVDQPCSLNTQPCCDDATC

SEQ ID NO: 654 - protein, 39 aa, Hadronyche versuta
QYCVPVDQPCSLNTQPCCDDAYCTQERNENGHTVYYCRA

SEQ ID NO: 655 - protein, 39 aa, Hadronyche versuta; identical to SEQ ID NO: 571

SEQ ID NO: 656 - protein, 74 aa, Hadronyche versuta
MNTATGFIVLLVLATILGGIEAGESHMRKDAMGRVRRQYCVPVDQPCSLNTQPCCDDATCTERNENGHTVYYCR

SEQ ID NO: 657 - protein, 38 aa, Hadronyche versuta; identical to SEQ ID NO: 573

SEQ ID NO: 658 - protein, 75 aa, Hadronyche versuta
MNTATGFIVLLVLATVLGGIEAGESHMRKDAMGRVRRQYCVPVDQPCSLNTQPCCDDAYCTQELNENDNTVYYCR

SEQ ID NO: 659 - protein, 38 aa, Hadronyche versuta; identical to SEQ ID NO: 575

SEQ ID NO: 660 - protein, 76 aa, Hadronyche versuta; identical to SEQ ID NO: 576

SEQ ID NO: 661 - protein, 39 aa, Hadronyche versuta; identical to SEQ ID NO: 12

SEQ ID NO: 662 - protein, 76 aa, Hadronyche versuta; identical to SEQ ID NO: 578

SEQ ID NO: 663 - protein, 39 aa, Hadronyche versuta; identical to SEQ ID NO: 6

SEQ ID NO: 664 - protein, 76 aa, Hadronyche versuta
MNTTTGFIVLLVLATILGGIEAGESHMRKDAMGRVRRQYCVPVDQPCSLNTQPCCDDAYCTQELNENDNTVYYCRA

SEQ ID NO: 665 - protein, 39 aa, Hadronyche versuta; identical to SEQ ID NO: 581

SEQ ID NO: 666 - protein, 76 aa, Hadronyche versuta; identical to SEQ ID NO: 582

SEQ ID NO: 667 - protein, 39 aa, Hadronyche versuta; identical to SEQ ID NO: 581

SEQ ID NO: 668 - protein, 76 aa, Hadronyche versuta; identical to SEQ ID NO: 584

SEQ ID NO: 669 - protein, 39 aa, Hadronyche versuta; identical to SEQ ID NO: 581

SEQ ID NO: 670 - protein, 76 aa, Atrax robustus; identical to SEQ ID NO: 586

SEQ ID NO: 671 - protein, 39 aa, Atrax robustus; identical to SEQ ID NO: 581

SEQ ID NO: 672 - protein, 22 aa, Hadronyche versuta
  SITE 4: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
  SITE 10: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
  SITE 16: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
  SITE 20: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
MNTXTGFIVXLVLATXLGGXEA

SEQ ID NO: 673 - protein, 15 aa, Hadronyche versuta
  SITE 1: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
XESHMRKDAMGRVRR

SEQ ID NO: 674 - protein, 64 aa, Leiurus quinquestriatus hebraeus
VRDAYIAKNYNCVYECFRDAYCNELCTKNGASSGYCQWAGKYGNACWCYALPDNVPIRVPGKCR

SEQ ID NO: 675 - protein, 64 aa, Leiurus quinquestriatus quinquestriatus
VRDAYIAKNYNCVYECFRDSYCNDLCTKNGASSGYCQWAGKYGNACWCYALPDNVPIRVPGKCH

SEQ ID NO: 676 - protein, 65 aa, Bothus occitanus tunetanus
VRDAYIAQNYNCVYFCMKDDYCNDLCTKNGASSGYCQWAGKYGNACWCYALPDNVPIRIPGKCHS

SEQ ID NO: 677 - protein, 64 aa, Hottentotta judaica
GRDAYALDNLNCAYTCGSKSYCNTECTKNGAVSGYCQWLGKYGNACWCINLPDKVPIRIPGACR

SEQ ID NO: 678 - protein, 67 aa, Leiurus quinquestriatus hebraeus
VRDGYIAQPENCVYHCFPGSSGCDTLCKEKGGTSGHCGFKVGHGLACWCNALPDNVGIIVEGEKCHS

SEQ ID NO: 679 - protein, 66 aa, Buthus occitanus mardochei
GRDGYIAQPENCVYHCFPGSSGCDTLCKEKGATSGHCGFLPGSGVACWCDNLPNKVPIVVGGEKCH

SEQ ID NO: 680 - protein, 65 aa, Buthus occitanus mardochei
GRDAYIAQPENCVYECAKNSYCNDLCTKNGAKSGYCQWLGKYGNACWCEDLPDNVPIRIPGKCHF

SEQ ID NO: 681 - protein, 64 aa, Bothus martensii Karsch
VRDAYIAKPHNCVYECARNEYCNDLCTKNGAKSGYCQWVGKYGNGCWCIELPDNVPIRVPGKCH

SEQ ID NO: 682 - protein, 64 aa, Bothus martensii Karsch
VRDAYIAKPHNCVYSCARNEWCNDLCTKNGAKSGYCQWVGKYGNGCWCIELPDNVPIRVPGKCH

SEQ ID NO: 683 - protein, 64 aa, Bothus martensii Karsch
VRDAYIAKPENCVYHCAGNEGCNKLCTDNGAESGYCQWGGRYGNACWCIKLPDDVPIRVPGKCH

SEQ ID NO: 684 - protein, 66 aa, Bothus martensii Karsch
VRDGYIALPHNCAYGCLNNEYCNNLCTKDGAKIGYCNIVGKYGNACWCIQLPDNVPIRVPGRCHPA

SEQ ID NO: 685 - protein, 64 aa, Leiurus quinquestriatus
VRDGYIAQPENCVYHCIPDCDTLCKDNGGTGGHCGFKLGHGIACWCNALPDNVGIIVDGVKCHK

SEQ ID NO: 686 - protein, 66 aa, Leiurus quinquestriatus
VRDGYIAKPENCAHHCFPGSSGCDTLCKENGGTGGHCGFKVGHGTACWCNALPDKVGIIVDGVKCH

SEQ ID NO: 687 - protein, 66 aa, Centruroides noxius
KEGYLVDIKNTGCKYECLKLGDNDYCLRECKQQYGKGAGGYCYAFACWCTHLYEQAIVWPLPNKRC

SEQ ID NO: 688 - protein, 66 aa, Centruroides noxius
KEGYLVELGTGCKYECFKLGDNDYCLRECKARYGKGAGGYCYAFGCWCTQLYEQAVVWPLKNKTCR

SEQ ID NO: 689 - protein, 66 aa, Centruroides suffusus suffusus
KEGYLVSKSTGCKYECLKLGDNDYCLRECKQQYGKSSGGYCYAFACWCTHLYEQAVVWPLPNKTCN

SEQ ID NO: 690 - protein, 66 aa, Centruroides suffusus suffusus
KEGYLVNSYTGCKFECFKLGDNDYCLRECRQQYGKGSGGYCYAFGCWCTHLYEQAVVWPLPNKTCN

SEQ ID NO: 691 - protein, 76 aa, Buthotus judaicus
KKNGYPLDRNGKTTECSGVNAIAPHYCNSECTKVYVAESGYCCWGACYCFGLEDDKPIGPMKDITKKYCDVQIIPS

SEQ ID NO: 692 - protein, 70 aa, Androctonus australis Hector; identical to SEQ ID NO: 645

SEQ ID NO: 693 - protein, 70 aa, Leiurus quinquestriatus quinquestriatus
KKNGYAVDSSGKAPECLLSNYCYNECTKVHYADKGYCCLLSCYCVGLSDDKKVLEISDARKKYCDFVTIN

SEQ ID NO: 694 - protein, 70 aa, Leiurus quinquestriatus hebraeus
KKNGFAVDSNGKAPECFFDHYCNSECTKVYYAEKGYCCLLSCYCFGLNDDKKVLEISDTTKKYCDFTIIN

SEQ ID NO: 695 - protein, 72 aa, Bothus martensii Karsch
KKNGYAVDSSGKVAECLFNNYCNNECTKVYYADKGYCCLLKCYCFGLLDDKPVLDIWDSTKNYCDVQIIDLS

SEQ ID NO: 696 - protein, 61 aa, Leiurus quinquestriatus hebraeus
DGYIKRRDGCKVACLIGNEGCDKECKAYGGSYGYCWTWGLACWCEGLPDDKTWKSETNTCG

SEQ ID NO: 697 - protein, 60 aa, Leiurus quinquestriatus hebraeus
DGYIRGDGCKVSCVINHVFCDNECKAAGGSYGYCWAWGLACWCEGLPAEREWKYETNTCG

SEQ ID NO: 698 - protein, 62 aa, Buthotus judaicus
DGYIRKKDGCKVSCIIGNEGCRKECVAHGGSFGYCWTWGLACWCENLPDAVTWKSSTNTCGR

SEQ ID NO: 699 - protein, 61 aa, Buthacus arenicola
DGYIRRRDGCKVSCLFGNEGCDKECKAYGGSYGYCWTWGLACWCEGLPDDKTWKSETNTCG

SEQ ID NO: 700 - protein, 61 aa, Leiurus quinquestriatus quinquestriatus
DGYIRKRDGCKLSCLFGNEGCNKECKSYGGSYGYCWTWGLACWCEGLPDDKTWKSETNTCG

SEQ ID NO: 701 - protein, 60 aa, Bothus occitanus tunetanus
DGYIKGYKGCKITCVINDDYCDTECKAEGGTYGYCWKWGLACWCEDLPDEKRWKSETNTC

SEQ ID NO: 702 - protein, 63 aa, Leiurus quinquestriatus hebraeus
DNGYLLNKATGCKVWCVINNASCNSECKLRRGNYGYCYFWKLACYCEGAPKSELWAYATNKCN

SEQ ID NO: 703 - protein, 62 aa, Tityus serrulatus
KEGYLMDHEGCKLSCFIRPSGYCGRECGIKKGSSGYCYAWPACYCYGLPNWVKVWDRATNKC

SEQ ID NO: 704 - protein, 64 aa, Tityus zulianus
KDGYLVGNDGCKYSCFTRPGTYCANECSRVKGKDGYCYAWMACYCYSMPNWVKTWDRATNRCGR

SEQ ID NO: 705 - protein, 29 aa, Oldenlandia affinis
GLPVCGETCVGGTCNTPGCTCSWPVCTRN

SEQ ID NO: 706 - protein, 29 aa, Oldenlandia affinis
CGETCFGGTCNTPGCSCTWPICTRDGLPV

SEQ ID NO: 707 - protein, 30 aa, Oldenlandia affinis
GTPCGESCVYIPCISGVIGCSCTDKVCYLN

SEQ ID NO: 708 - protein, 10 aa, synthetic construct
  REGION 1..10: note = Synthetically Created Peptide
YDPAPPPPPP

SEQ ID NO: 709 - protein, 20 aa, synthetic construct
  REGION 1..20: note = Synthetically Created Peptide
HHHHHHIEGRYDPAPPPPPP

SEQ ID NO: 710 - protein, 8 aa, synthetic construct
  REGION 1..8: note = Synthetically created peptide
YDPAPPPP

SEQ ID NO: 711 - protein, 6 aa, synthetic construct
  REGION 1..6: note = Synthetically Created Peptide
YDPAPP

SEQ ID NO: 712 - protein, 5 aa, synthetic construct
  REGION 1..5: note = Synthetically Created Peptide
YDPAP

SEQ ID NO: 713 - protein, 6 aa, synthetic construct
  REGION 1..6: note = Synthetically Created Peptide
YDPAPR

SEQ ID NO: 714 - protein, 4 aa, synthetic construct
  REGION 1..4: note = Synthetically Created Peptide
YDPA

SEQ ID NO: 715 - protein, 5 aa, synthetic construct
  REGION 1..5: note = Synthetically Created Peptide
YDPAR

SEQ ID NO: 716 - protein, 20 aa, synthetic construct
  REGION 1..20: note = Synthetically Created Peptide
YDPARYDPARYDPARYDPAR

SEQ ID NO: 717 - protein, 4 aa, synthetic construct
  REGION 1..4: note = Synthetically Created Peptide
YDPR

SEQ ID NO: 718 - protein, 4 aa, synthetic construct
  REGION 1..4: note = Synthetically Created Peptide
DPAR

SEQ ID NO: 719 - protein, 16 aa, synthetic construct
  REGION 1..16: note = Synthetically Created Peptide
DPARDPARDPARDPAR

SEQ ID NO: 720 - protein, 9 aa, synthetic construct
  REGION 1..9: note = Synthetically Created Peptide
DPAPPPPPP

SEQ ID NO: 721 - protein, 8 aa, synthetic construct
  REGION 1..8: note = Synthetically Created Peptide
PAPPPPPP

SEQ ID NO: 722 - protein, 33 aa, Scorpio Maurus
GDCLPHLKLCKENKDCCSKKCKRRGTNIEKRCR

SEQ ID NO: 723 - protein, 64 aa, Mesobuthus eupeus
MSTFVVVFLLLTAILCHAEHAIDETARGCNRLNKKCNSDADCCRYGERCISTGVNYYCRPDVGP

SEQ ID NO: 724 - protein, 85 aa, Atrax robustus
MNTATGFIVLLVLATVLGAIEAEDAVPDFEGGFASHAREDTVGGKIRRSSVCIPSGQPCPYNEHCCSGSCTYKENENGNTVQRCD

SEQ ID NO: 725 - protein, 73 aa, Atrax robustus; identical to SEQ ID NO: 602

SEQ ID NO: 726 - protein, 78 aa, Atrax robustus; identical to SEQ ID NO: 592

SEQ ID NO: 727 - protein, 78 aa, Atrax robustus; identical to SEQ ID NO: 600

SEQ ID NO: 728 - protein, 78 aa, Atrax robustus; identical to SEQ ID NO: 596

SEQ ID NO: 729 - protein, 29 aa, Grammostola rosea
YCQKWLWTCDSERKCCEDMVCRLWCKKRL

SEQ ID NO: 730 - protein, 31 aa, Grammostola rosea
YCQKWMWTCDEERKCCEGLVCRLWCKKKIEW

SEQ ID NO: 731 - protein, 32 aa, Ctenus ornatus
APCTYPGQQCKSDDECCHGTCKTAFIGRICMR

SEQ ID NO: 732 - protein, 86 aa, Chilobrachys jingzhao
MKVSVLITLAVLGVMFVWASAAELEERGSDQRDSPAWLKSMERIFQSGERECRKMFGGCSVDSDCCAHLGCKPTLKYCAWDGTFGK

SEQ ID NO: 733 - protein, 29 aa, Chilobrachys jingzhao
YCQKWMWTCDSERKCCEGYVCELWCKYNL

SEQ ID NO: 734 - protein, 62 aa, Chilobrachys jingzhao
MKTSILFVIFSLALLFALSAATEIEETDRACGQFWWKCGEGKPPCCANFACKIGLYLCIWSP

SEQ ID NO: 735 - protein, 63 aa, Chilobrachys jingzhao
MKNTSILFILGLALLLVLAFEAQVGESDGECGGFWWKCGRGKPPCCKGYACSKTWGWCAVEAP

SEQ ID NO: 736 - protein, 83 aa, Chilobrachys jingzhao
MKASVFAVILGLVVLCACSFAEDEQDQFVSPNELLKSMFVESRHEFTPEVEGRYCQKWMWTCDSKRACCEGLRCKLWCRKIIG

SEQ ID NO: 737 - protein, 31 aa, Grammostola rosea
YCQKWMWTCDEERKCCEGLVCRLWCKRIINM

SEQ ID NO: 738 - protein, 82 aa, Grammostola rosea
MKTSVVFVIAGLALLSVVCYASELKEQSSVNEVLSTIFHFEQPEERGCLEFWWKCNPNDDKCCRPKLKCSKLFKLCNFSFGK

SEQ ID NO: 739 - protein, 69 aa, Agelena orientalis
MRAIISLLLISAMVFSMIEAVPVEEGLQLFEGERGGCLPRNKFCNPSSGPRCCSGLTCKELNIWANKCL

SEQ ID NO: 740 - protein, 69 aa, Agelena orientalis
MRAIISLLLISAMVFSMIEAVPLEEGLQLFEGERGCLPRNKFCNPSSGPRCCSGLTCKELNIWDSRCLG

SEQ ID NO: 741 - protein, 68 aa, Agelena orientalis
MRAIISLLLISAMVFSMIEAVPLEEGLQLFEGERGCLPRNKFCNPSSGPRCCSGLTCKELNIWASKCL

SEQ ID NO: 742 - protein, 69 aa, Agelena orientalis
MRAIISLLLISAMVFSMIEAVPVEEGLQLFEGERGGCLPRNKFCNPSSGPRCCSGLTCKELNIWASKCL

SEQ ID NO: 743 - protein, 68 aa, Agelena orientalis
MKAIISLLLISAMVFSMIEAVPLEEGLQLFEGERGCLPHNRFCNALSGPRCCSGLTCKELNIWASKCL

SEQ ID NO: 744 - protein, 70 aa, Agelena orientalis
MKAIISLLLISAMVFSIIEPVPKKKGLQLSENERGGCLPHNKFCNALSGPRCCSGLKCKELTIWNTKCLE

SEQ ID NO: 745 - protein, 70 aa, Agelena orientalis
MRSIISLILISAMVFSMIAPVPEEERLQLSEDERGGCLPHNRFCNALTGPRCCSRLRCKELSIWDSICLG

SEQ ID NO: 746 - protein, 70 aa, Agelena orientalis
  SITE 23: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
  SITE 24: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
MRAIISLILISAMVFSMIAAVPXXEGLQLSEDERGGCLPHNRFCNALSGPRCCSGLKCKELSIWDSICLG

SEQ ID NO: 747 - protein, 69 aa, Agelena orientalis
MKAIISLLLISAMVFSMFEAVPVRRRFTAFEGERGCLPHNRFCNALSGPRCCTGLKCKELSIWDSRCLG

SEQ ID NO: 748 - protein, 70 aa, Agelena orientalis
MRAIISLLLISAMVFYIIAAVPEEEGLQLSEDERGGCLPHNRFCNALSGPRCCSGLRCKELSIRDSRCLG

SEQ ID NO: 749 - protein, 70 aa, Agelena orientalis
  SITE 25: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
MRAIISLFLISAMVFSMIQAVPEEXGLQLSEDERGGCLPHNRFCNALSGPRCCSGLKCKELSIWDSTCLG

SEQ ID NO: 750 - protein, 70 aa, Agelena orientalis
MRAIISLLLISAMVFSIIEAVPEEEGLQLSEDERGGCLPHNRFCNALSDPRCCSGLRCKELSIWDSRCLG

SEQ ID NO: 751 - protein, 70 aa, Agelena orientalis
MRAIISLLLISAMVFSMIAAVPEEEGLQLSEDERGGCLPHNRFCNALSGPRCCSGLRCKELSIWDSTCLG

SEQ ID NO: 752 - protein, 69 aa, Agelena orientalis
  SITE 24: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
  SITE 25: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
MKAIISLLLISAMVFSMIEAVPVXXGLQLFESERGCLPHNRFCNALSGPRCCSRLKCKELSIWDSRCLG

SEQ ID NO: 753 - protein, 69 aa, Agelena orientalis
MKAIISLLLISAMVFSMIEAVPLEEGLQLFEGERGCLPHNTFCNALSGPRCCSGLKCKELSIWDSRCLG

SEQ ID NO: 754 - protein, 69 aa, Agelena orientalis
MKAIISLLLISAMVFSMIEAVPVEEGLQLFEGERGCLPHNRFCNALSGPRCCSGLRCKELSIWDSRCLG

SEQ ID NO: 755 - protein, 70 aa, Agelena orientalis
MRAIISLFLISAMVFSMIQAVPEEKGLQLSEDERGGCLPHNRFCNALSGPRCCSRLKCKELSIWDSRCLG

SEQ ID NO: 756 - protein, 69 aa, Agelena orientalis
MRAIISVLLISAMVFSIIEAVPLEEGLQLFEAERVGCLPRNRFCNALSGPRCCSGLRCKELSIWASKCL

SEQ ID NO: 757 - protein, 70 aa, Agelena orientalis
MRAIIYLLLISAMVFSMTKAVPEEEGLQLSEDERGGCLPHNRFCNALSGPRCCSGLKCKELSIYDSRCLG

SEQ ID NO: 758 - protein, 69 aa, Agelena orientalis
MKAIISLLLISAMVFSMIEAVPVEEGLQLFEGERGCLPHNRFCNALSGPRCCSGLKCKELSIWDSRCLG

SEQ ID NO: 759 - protein, 70 aa, Agelena orientalis
MRAIISLILISAMVFSMIAAVPEEEGLQLSEDERGGCLPHNRFCNALSGPRCCSGLRCKELSIWDSRCLG

SEQ ID NO: 760 - protein, 33 aa, Phoneutria nigriventer
VFCRFNGQQCTSDGQCCYGKCRTAFLRMICMGG

SEQ ID NO: 761 - protein, 43 aa, Agelenopsis aperta
  SITE 20: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
  SITE 40: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
NCIDFGGDCDGEKDDCQCCXRNGYCSCYNLFGYLKRGCKXEVG

SEQ ID NO: 762 - protein, 39 aa, Missulena bradleyi
SPVCTPSGQPCQPNTQPCCNNAEEEQTINCNGNTVYRCA

SEQ ID NO: 763 - protein, 36 aa, Hadronyche infensa; identical to SEQ ID NO: 615

SEQ ID NO: 764 - protein, 37 aa, Hadronyche versuta; identical to SEQ ID NO: 24

SEQ ID NO: 765 - protein, 37 aa, Hadronyche formidabilis; identical to SEQ ID NO: 631

SEQ ID NO: 766 - protein, 37 aa, Hadronyche infensa; identical to SEQ ID NO: 609

SEQ ID NO: 767 - protein, 37 aa, Hadronyche versuta
SSTCIPSGQPCPYNENCCSQSCTYKENENGNTVKRCD

SEQ ID NO: 768 - protein, 37 aa, Hadronyche infensa; identical to SEQ ID NO: 613

SEQ ID NO: 769 - protein, 37 aa, Hadronyche versuta
SSTCIPSGQPCPYNENCCSQSCTFKENENGNTVKRCD

SEQ ID NO: 770 - protein, 37 aa, Hadronyche versuta; identical to SEQ ID NO: 601

SEQ ID NO: 771 - protein, 37 aa, Hadronyche versuta
SPTCIPSGQPCPYNENCCSQSCTYKENENGNTVKRCD

SEQ ID NO: 772 - protein, 37 aa, Hadronyche versuta
SAVCIPSGQPCPYSKYCCSGSCTYKTNENGNSVQRCD

SEQ ID NO: 773 - protein, 45 aa, Hadronyche versuta; identical to SEQ ID NO: 589

SEQ ID NO: 774 - protein, 32 aa, Phoneutria nigriventer
VFCRSNGQQCTSDGQCCYGKCMTAFMGKICMR

SEQ ID NO: 775 - protein, 32 aa, Phoneutria reidyi
AFCRFNGQQCTSDGQCCNGRCINAFQGRICIG

SEQ ID NO: 776 - protein, 33 aa, Ceratogyrus marshalli
DCLGWFKSCDPKNDKCCKNYTCSRRDRWCKYDL

SEQ ID NO: 777 - protein, 39 aa, Aphonopelma sp
IFECVFSCDIEKEGKPCKPKGEKKCTGGWKCKIKLCLKI

SEQ ID NO: 778 - protein, 29 aa, Grammostola rosea
YCQKWMWTCDSKRKCCEDMVCQLWCKKRL

SEQ ID NO: 779 - protein, 35 aa, Heteroscodra maculata
ECRYLFGGCSSTSDCCKHLSCRSDWKYCAWDGTFS

SEQ ID NO: 780 - protein, 35 aa, Psalmopoeus cambridgei
SECRWFMGGCDSTLDCCKHLSCKMGLYYCAWDGTF

SEQ ID NO: 781 - protein, 34 aa, Stromatopelma calceatum griseipes
TCRYLFGGCKTTADCCKHLACRSDGKYCAWDGTF

SEQ ID NO: 782 - protein, 34 aa, Stromatopelma calceatum
DCTRMFGACRRDSDCCPHLGCKPTSKYCAWDGTI

SEQ ID NO: 783 - protein, 35 aa, Theraphosa blondi
AACLGMFESCDPNNDKCCPNRECNRKHKWCKYKLW

SEQ ID NO: 784 - protein, 32 aa, Phoneutria keyserlingi
AFCKYNGEQCTSDGQCCNGRCRTAFMGKICMG

SEQ ID NO: 785 - protein, 35 aa, Phoneutria nigriventer
MPCPKILKQCKSDEDCCRGWKCFGFSIKDKMCISR

SEQ ID NO: 786 - protein, 40 aa, Phoneutria reidyi
ECADVYKEVWYPEKPCCKDRACQCSLGMNCKCKATLGDIF

SEQ ID NO: 787 - protein, 31 aa, Phoneutria nigriventer
VFCRFNGQQCTSDGQCCYGKCRTAFMGKICM

SEQ ID NO: 788 - protein, 36 aa, Phoneutria nigriventer
IACAPRFSLCNSDKECCKGLRCKSRIANMWPTFCSQ

SEQ ID NO: 789 - protein, 36 aa, Phoneutria reidyi
IACAPRGLLCFRDKECCKGLTCKGRFVNTWPTFCLV

SEQ ID NO: 790 - protein, 32 aa, Phoneutria nigriventer
SFCIPFKPCKSDENCCKKFKCKTTGIVKLCRW

SEQ ID NO: 791 - protein, 33 aa, Ceratogyrus marshalli
DCLGWFKSCDPKNDKCCKNYTCSRRDRWCKYYL

SEQ ID NO: 792 - protein, 39 aa, Aphonopelma sp
IFECVFSCDIEKEGKPCKPKGEKKCSGGWKCKIKLCLKI

SEQ ID NO: 793 - protein, 38 aa, Heteroscodra maculata
ECRYFWGECNDEMVCCEHLVCKEKWPITYKICVWDRTF

SEQ ID NO: 794 - protein, 35 aa, Psalmopoeus cambridgei
GACRWFLGGCKSTSDCCEHLSCKMGLDYCAWDGTF

SEQ ID NO: 795 - protein, 35 aa, Theraphosa blondi
DDCLGMFSSCDPKNDKCCPNRVCRSRDQWCKYKLW

SEQ ID NO: 796 - protein, 36 aa, Phoneutria keyserlingi
IACAPRGQLCFSDKLCCIGLRCKSRVANMWPTFCLV

SEQ ID NO: 797 - protein, 34 aa, Phoneutria nigriventer
  SITE 31: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
GCANAYKSCNGPHTCCWGYNGYKKACICSGXNWK

SEQ ID NO: 798 - protein, 39 aa, Ceratogyrus marshalli
GVDKEGCRKLLGGCTIDDDCCPHLGCNKKYWHCGWDGTF

SEQ ID NO: 799 - protein, 34 aa, Paraphysa scrofa
DCLGFLWKCNPSNDKCCRPNLVCSRKDKWCKYQI

SEQ ID NO: 800 - protein, 34 aa, Psalmopoeus cambridgei
ECRWYLGGCKEDSECCEHLQCHSYWEWCLWDGSF

SEQ ID NO: 801 - protein, 35 aa, Theraphosa blondi
DDCLGMFSSCDPNNDKCCPNRVCRVRDQWCKYKLW

SEQ ID NO: 802 - protein, 41 aa, Hysterocrates gigas
GVDKAGCRYMFGGCSVNDDCCPRLGCHSLFSYCAWDLTFSD

SEQ ID NO: 803 - protein, 37 aa, Heteropoda venatoria
DDDCGWIMDDCTSDSDCCPNWVCSKTGFVKNICKYEM

SEQ ID NO: 804 - protein, 36 aa, Heteropoda venatoria
ADCGWLFHSCESNADCCENWACATTGRFRYLCKYQI

SEQ ID NO: 805 - protein, 35 aa, Agelena orientalis
GGCLPHNRFCNALSGPRCCSGLKCKELSIWDSRCL

SEQ ID NO: 806 - protein, 70 aa, Agelena orientalis
MRAIISLFLISAMVFSMIQAVPEEEGLQLSEDERGGCLPHNRFCNALSGPRCCSGLKCKELSIWDSRCLG

SEQ ID NO: 807 - protein, 88 aa, Latrodectus tredecimguttatus
MSKLFFVVFLCLIISVFAISPADIGCTDISQADFDEKNNNCIKCGEDGFGEEMVNRCRDKCFTDNFYQSCVDLLNKVYEEKDTPPVQE

SEQ ID NO: 808 - protein, 33 aa, Phoneutria nigriventer
GFCAQKGIKCHDIHCCTNLKCVREGSNRVCRKA

SEQ ID NO: 809 - protein, 86 aa, Psalmopoeus cambridgei
MMRVLIVTAVFTFFLVLTSSGHDEDNEQRNILEGMFLDRAIETPKGLEEKRACGILHDNCVYVPAQNPCCRGLQCRYGKCLVQVGR

SEQ ID NO: 810 - protein, 65 aa, Psalmopoeus cambridgei
MGFKLVLFIAVLTLVGSSNAEISAKMDSRDSPMIQERRCLPAGKTCVRGPMRVPCCGSCSQNKCT

SEQ ID NO: 811 - protein, 36 aa, Plesiophrictus guangxiensis
DGECGGFWWKCGSGKPACCPKYVCSPKWGLCNFPMP

SEQ ID NO: 812 - protein, 36 aa, Plesiophrictus guangxiensis
EGECGGFWWKCGSGKPACCPKYVCSPKWGLCNFPMP

SEQ ID NO: 813 - protein, 33 aa, Plesiophrictus guangxiensis
ECRKMFGGCSVDSDCCAHLGCKPTLKYCAWDGT

SEQ ID NO: 814 - protein, 68 aa, Haplopelma huwenum
MNMKILVLVAVLCLVVSTHAERHSKTDMEDMEDSPMIQERKCLPPGKPCYGATQKIPCCGVCSHNKCT

SEQ ID NO: 815 - protein, 55 aa, Haplopelma huwenum
IDTCRLPSDRGRCKASFERWYFNGRTCAKFIYGGCGGNGNKFPTQEACMKRCAKA

SEQ ID NO: 816 - protein, 81 aa, Haplopelma huwenum
MRASMFLALAGLVLLFVVCYASESEEKEFPRELLFKFFAVDDFKGEERACKGVFDACTPGKNECCPNRVCSDKHKWCKWKL

SEQ ID NO: 817 - protein, 85 aa, Haplopelma huwenum
MKVTLIAILTCAAVLVLHTTAAEELEAESQLMEVGMPDTELAAVDEERLFECSFSCEIEKEGDKPCKKKKCKGGWKCKFNMCVKV

SEQ ID NO: 818 - protein, 37 aa, Haplopelma huwenum
LFECSFSCEQEKEGDKPCKKKKCKGGWKCKFNMCVKV

SEQ ID NO: 819 - protein, 87 aa, Haplopelma huwenum
MVNMKASMFLTFAGLVLLFVVCYASESEEKEFPKEMLSSIFAVDNDFKQEERDCAGYMRECKEKLCCSGYVCSSRWKWCVLPAPWRR

SEQ ID NO: 820 - protein, 89 aa, Haplopelma huwenum
MVNMKASMFLALAGLVLLFVVCYASESEEKEFSNELLSSVLAVDDNSKGEERECLEIFKACNPSNDQCCKSSKLVCSRKTRWCKYQIGK

SEQ ID NO: 821 - protein, 86 aa, Haplopelma huwenum
MKSIVFVALFGLALLAVVCSASEDAHKELLKEVVRAMVVDKTDAVQAEERECRWYLGGCSQDGDCCKHLQCHSNYEWCVWDGTFSK

SEQ ID NO: 822 - protein, 41 aa, Haplopelma huwenum
NCIGEQVPCDENDPRCCSGLVVLKKTLHGIWIKSSYCYKCK

SEQ ID NO: 823 - protein, 83 aa, Haplopelma huwenum
MKVTLIAILTCAAVLVLHTTAAEELEESQLMEVGMPDTELAAVDEERLFECSISCEIEKKGESCKPKKCKGGWKCKFNMCVKV

SEQ ID NO: 824 - protein, 34 aa, Haplopelma huwenum
IICAPEGGPCVAGIGCCAGLRCSGAKLGLAGSCQ

SEQ ID NO: 825 - protein, 33 aa, Haplopelma hainanum
ECKGFGKSCVPGKNECCSGYACNSRDKWCKVLL

SEQ ID NO: 826 - protein, 33 aa, Haplopelma hainanum
GCKGFGDSCTPGKNECCPNYACSSKHKWCKVYL

SEQ ID NO: 827 - protein, 35 aa, Haplopelma hainanum
ECLGFGKGCNPSNDQCCKSSNLVCSRKHRWCKYEI

SEQ ID NO: 828 - protein, 35 aa, Haplopelma hainanum
ECLGFGKGCNPSNDQCCKSANLVCSRKHRWCKYEI

SEQ ID NO: 829 - protein, 35 aa, Grammostola rosea
ECRYLFGGCKTTSDCCKHLGCKFRDKYCAWDFTFS

SEQ ID NO: 830 - protein, 35 aa, Grammostola rosea
ECRYLFGGCKTTADCCKHLGCKFRDKYCAWDFTFS

SEQ ID NO: 831 - protein, 33 aa, Heteropoda venatoria
DCGTIWHYCGTDQSECCEGWKCSRQLCKYVIDW

SEQ ID NO: 832 - protein, 30 aa, Heteropoda venatoria
DDCGKLFSGCDTNADCCEGYVCRLWCKLDW

SEQ ID NO: 833 - protein, 31 aa, Heteropoda venatoria
ECGTLFSGCSTHADCCEGFICKLWCRYERTW

SEQ ID NO: 834 - protein, 29 aa, Heteropoda venatoria
DDCGTLFSGCDTSKDCCEGYVCHLWCKYK

SEQ ID NO: 835 - protein, 83 aa, Haplopelma huwenum
MKTSMFLTLTGLGLLFVVCYASESEEKEFPKELLSSIFAADSDFKVEERGCLGDKCDYNNGCCSGYVCSRTWKWCVLAGPWRR

SEQ ID NO: 836 - protein, 77 aa, Macrothele gigas
MKVFSFTVVVVMILSLSAFVLAGDEGDVMKKIVAMEEAVEERACLAEYQKCEGSTVPCCPGLSCSAGRFRKTKLCTK

SEQ ID NO: 837 - protein, 81 aa, Macrothele gigas
MKAPATIVILIMSLISVLWATADTEDGNLLFPIEDFIRKFDEYPVQPKERSCKLTFWRCKKDKECCGWNICTGLCIPPGKK

SEQ ID NO: 838 - protein, 38 aa, Macrothele gigas
CMGYDIHCTDRLPCCFGLECVKTSGYWWYKKTYCRRKS

SEQ ID NO: 839 - protein, 121 aa, Macrothele gigas
MMTLSPFLLLLIAAVVIGNASEGEVKNEFEERLKDEFKDPSRSEVAEVILLRELEVLEETLFGKEMTSDTEENRNSREKRCMGYDIECNENLPCCKHRKLECVETSGYWWYKRKYCRPIKG

SEQ ID NO: 840 - protein, 79 aa, Macrothele gigas
MKAPATTLILVMSLISVLWATPDLEEGDLLAELGDLIATDDEYPMKPEERGCKLTFWKCKNKKECCGWNACALGICMPR

SEQ ID NO: 841 - protein, 77 aa, Macrothele gigas
MKVFSFTIGLVVIISLFAFALAYDEETDLMKKLVEMERAIEQRIICAPEGGPCVVGIGCCKGYSCAPGLLGLVGHCQ

SEQ ID NO: 842 - protein, 81 aa, Macrothele gigas
MKYVMVILGLLVLAAICCASEVEELDWRQEIARAILEAELQPEERDCKGLFRQCKKSSECCKGSSCESDLTGLCIFNLPGR

SEQ ID NO: 843 - protein, 80 aa, Macrothele gigas
MKFATFAFTLCVVISLSVLVLADEEEKDFLMNLIQPLKESEERQFCGTNGKPCVNGQCCGALRCVVTYHYADGVCLKMNP

SEQ ID NO: 844 - protein, 39 aa, Brachypelma albiceps
ILECVFSCDIKKEGKPCKPKGEKKCTGGWRCKIKLCLKI

SEQ ID NO: 845 - protein, 39 aa, Brachypelma smithi; identical to SEQ ID NO: 792

SEQ ID NO: 846 - protein, 29 aa, Paraphysa scrofa
YCQKWMWTCDSARKCCEGLVCRLWCKKII

SEQ ID NO: 847 - protein, 40 aa, Psalmopoeus cambridgei
EDCIPKWKGCVNRHGDCCEGLECWKRRRSFEVCVPKTPKT

SEQ ID NO: 848 - protein, 39 aa, Brachypelma albiceps
IFECVFSCDIKKEGKPCKPKGEKKCTGGWRCKIKLCLKI

SEQ ID NO: 849 - protein, 31 aa, Paraphysa scrofa; identical to SEQ ID NO: 737

SEQ ID NO: 850 - protein, 34 aa, Brachypelma smithi
SCVDFQTKCKKDSDCCGKLECSSRWKWCVYPSPF

SEQ ID NO: 851 - protein, 32 aa, Apomastus schleringi
WLGCARVKEACGPWEWPCCSGLKCDGSECHPQ

SEQ ID NO: 852 - protein, 35 aa, Thrixopelma pruriens
ECRYWLGGCSAGQTCCKHLVCSRRHGWCVWDGTFS

SEQ ID NO: 853 - protein, 30 aa, Thrixopelma pruriens
YCQKWMWTCDSERKCCEGMVCRLWCKKKLW

SEQ ID NO: 854 - protein, 99 aa, Macrothele gigas
TSQGTTPDKVQLEVNCISNLPNNEVEETDLLRELEMIEENLFGKELSFVPEENRNSRHKRCMGYDIECNERLHCCADLECVKTSGRWWYKKTYCRRKSG

SEQ ID NO: 855 - protein, 29 aa, Macrothele raveni
GCKLTFWKCKNKKECCGWNACALGICMPR

SEQ ID NO: 856 - protein, 30 aa, Heteropoda venatoria
DDCGGLFSGCDSNADCCEGYVCRLWCKYKL

SEQ ID NO: 857 - protein, 31 aa, Coremiocnemis valida
ACSRAGENCYKSGRCCDGLYCKAYVVTCYKP

SEQ ID NO: 858 - protein, 34 aa, Grammostola rosea
ECGKFMWKCKNSNDCCKDLVCSSRWKWCVLASPF

SEQ ID NO: 859 - protein, 32 aa, Grammostola rosea
YCQKWMWTCDEERKCCEGLVCRLWCKKKIEEG

SEQ ID NO: 860 - protein, 34 aa, Grammostola rosea
DCLGWFKGCDPDNDKCCEGYKCNRRDKWCKYKLW

SEQ ID NO: 861 - protein, 36 aa, Grammostola rosea
DCVRFWGKCSQTSDCCPHLACKSKWPRNICVWDGSV

SEQ ID NO: 862 - protein, 85 aa, Haplopelma huwenum
MKVTLIAILTCAAVLVLHTTAAEELEAESQLMEVGMPDTELAAVDEERPFECSFSCEIEKEGDKPCKKKKCKGGWKCKFNMCVKV

SEQ ID NO: 863 - protein, 88 aa, Haplopelma huwenum
MGIARILSAVLFLSVLFVVTFPALLSADHHDGRIDTCRLPSDRGRCKASFERWYFNGRTCAKFIYGGCGGNGNKFPTQEACMKRCGKA

SEQ ID NO: 864 - protein, 99 aa, Lasiodora sp
MNTIQVIIFAVVLVLTVTVGQADEDSPEASLLRKLKEAEASLFGQNLEESRNSRQKRCGGVDAPCDKDRPDCCSYAECLRPSGYGWWHGTYYCYRKRER

SEQ ID NO: 865 - protein, 81 aa, Haplopelma huwenum
MKASMFLALAGLVLLFVVCYASESEEKEFPRELLSKIFAVDDFKGEERACKGVFDACTPGKNECCSNRVCSDKHKWCKWKL

SEQ ID NO: 866 - protein, 102 aa, Hadronyche infensa
MKFSKLSLTLALILTQAIFVLCGKINEDFMENGLESHALHDEIRKPIDTEKADAERGVVDCVLNTLGCSSDKDCCGMTPSCTLGICAPSVGGLVGGLLGRAL

SEQ ID NO: 867 - protein, 102 aa, Hadronyche infensa
MKFSKLSLTLALILTQALLVVCGKINEDFMENGLESHALHDEIRKPIDTEKADAERGVLDCVVNTLGCSSDKDCCGMTPSCTLGICAPSVGGIVGGLLGRAL

SEQ ID NO: 868 - protein, 99 aa, Brachypelma smithi
MNTIQVIIFAVVLVLTVTVGQADEDSAETSLLRKLEEAEAAMFGQYLEESKNSREKRCIGESVPCDKDDPRCCREYECLKPTGYGWWYASYYCYRKKSG

SEQ ID NO: 869 - protein, 81 aa, Haplopelma huwenum
MKASMFLAFAGLVLLFVVCYASESEEKEFPRELISKIFAVDDFKGEERACKGVFGACTPGKNECCPNRVCSDKHKWCKWKL

SEQ ID NO: 870 - protein, 84 aa, Haplopelma huwenum
MKVTLIAILTCAAVLVLHTTAAEELEAESQLMEVGMPDTELAAVDEERLFECSISCEIEKKGESCKPKECKGGWKCKFNMCVKV

SEQ ID NO: 871 - protein, 83 aa, Haplopelma huwenum
MKTSMFLTLTGLVLLFVVCYASESEEKEFPKELLSSIFAADSDFKEEERGCFGYKCDYYKGCCSGYVCSPTWKWCVRPGPGRR

SEQ ID NO: 872 - protein, 85 aa, Haplopelma huwenum
MKVTLIAILTCAAVLVLHTTAAEELEAESQLMEVGMPDTELAAVDEERLFECSFSCEIEKEGDKLCKKKKCKGGWKCKFNMCVKV

SEQ ID NO: 873 - protein, 88 aa, Latrodectus tredecimguttatus
MLKLICIAFLVTVLTLVAGQDSLDPAEFGCADDVNQAELLKNNDICLQCEDLHKEGVVFSLCKTNCFTTEYFQHCVKDLEEAKKEPPE

SEQ ID NO: 874 - protein, 37 aa, Atrax robustus; identical to SEQ ID NO: 627

SEQ ID NO: 875 - protein, 76 aa, Atrax robustus; identical to SEQ ID NO: 582

SEQ ID NO: 876 - protein, 78 aa, Atrax robustus; identical to SEQ ID NO: 594

SEQ ID NO: 877 - protein, 39 aa, Brachypelma smithi
IIECVFSCDIEKEGKPCKPKGEKKCSGGWKCKIKLCLKI

SEQ ID NO: 878 - protein, 83 aa, Hadronyche venenata
MNTATGVIALLVLATVIGCIEAETRADLQGAFESYEGEAAEKIFRRSPTCIPSGQPCPYNENCCSKSCTYKEMKTATPVQRCD

SEQ ID NO: 879 - protein, 84 aa, Hadronyche venenata
MNTATGVIALVVLATVIGCIEAEETRADLQGAFESYEGEAADKIFRRSPTCIPSGQPCPYNENCCSKSCTYKENENGNTVQRCD

SEQ ID NO: 880 - protein, 84 aa, Hadronyche venenata
MNTATGVIALLVLATVIGCIEAEETRADLQGAFESYEGEGADKIFRRSPTCIPSGQPCPYNENCCSKSCTYKENENGNTVQRCD

SEQ ID NO: 881 - protein, 84 aa, Hadronyche venenata
MNTATGVIALLVLATVIGCIEVEETRADLQGAFESYEGEAAEKIFRRSPTCIPSGQPCPYNENCCSKSCTYKENENGNTVQRCD

SEQ ID NO: 882 - protein, 84 aa, Hadronyche venenata
MNTATGVIALLVLATVIGCIEAEETRADLQGAFESYEGEAADKIFRRSPTCIPSGQPCPYNENCCSKSCTYKENENGNTVQRCD

SEQ ID NO: 883 - protein, 84 aa, Hadronyche venenata
MNTATGVIALLVLATVIGCIEAEDTRADLQGGLESYEGEAADKIFRRSPTCIPSGQPCPYNENCCSKSCTYKENENGNTVQRCD

SEQ ID NO: 884 - protein, 76 aa, Hadronyche versuta; identical to SEQ ID NO: 582

SEQ ID NO: 885 - protein, 76 aa, Hadronyche versuta; identical to SEQ ID NO: 580

SEQ ID NO: 886 - protein, 76 aa, Hadronyche versuta; identical to SEQ ID NO: 584

SEQ ID NO: 887 - protein, 65 aa, Haplopelma huwenum
MNMKILVLVAVLCLVVSTHAERHSKTDMEDSPMIQERKCLPPGKPCYGATQKIPCCGVCSHNKCT

SEQ ID NO: 888 - protein, 32 aa, Haplopelma huwenum
DCAGYMRECKEKLCCSGYVCSSRWKWCVLPAP

SEQ ID NO: 889 - protein, 33 aa, Haplopelma huwenum
ECRWYLGGCSQDGDCCKHLQCHSNYEWCVWDGT

SEQ ID NO: 890 - protein, 83 aa, Haplopelma huwenum
MKTSMFLTLTGLVLLFVVCYASESEEKDFPKELLSSIFAADSDFKVEERGCLGDKCDYNNGCCSGYVCSRTWKWCVLAGPWRR

SEQ ID NO: 891 - protein, 81 aa, Haplopelma huwenum
MKASMFLTFAGLVLLFVVCYASESEEKEFPRELISKIFAVDDFKGEERACKGVFDACTPGKNECCPNRVCSDKHKWCKWKL

SEQ ID NO: 892 - protein, 81 aa, Haplopelma huwenum
MKASMFLAFAGLALLFVVCYASESEEKEFPRELISKIFAVDDFKGEERACKGVFDACTPGKNECCPNRVCSDKHKWCKWKL

SEQ ID NO: 893 - protein, 81 aa, Haplopelma huwenum
MKASMFLAFAGLVLLFVVCYASESEEKEFPRELISKIFAVDDFKGEERACKGVFDACTPGKNECCPNRVCSDKHKWCKWKL

SEQ ID NO: 894 - protein, 81 aa, Haplopelma huwenum
MEASMFLAFAGLVLLFVVCYASESEEKEFPRELISKIFAVDDFKGEERACKGVFDACTPGKNECCPNRVCSDKHKWCKWKL

SEQ ID NO: 895 - protein, 81 aa, Haplopelma huwenum
MKASMFLAFAGLVLLFVVCYASESEEKELPRELLSKIFAVDDFKGEERACKGVFDACTPGKNECCPNRVCSDKHKWCKWKL

SEQ ID NO: 896 - protein, 81 aa, Haplopelma huwenum
MKASMFLALAGLVLLFVVCYASESEEKEFPRELLSKIFAVDDFKGEERACKGVFDACTPGKNECCPNRVCSDKHKWCKWKL

SEQ ID NO: 897 - protein, 83 aa, Haplopelma huwenum; identical to SEQ ID NO: 890

SEQ ID NO: 898 - protein, 83 aa, Haplopelma huwenum
MKTSMFLTLTGLVLLFVDCYASESEEKEFPKELLSSIFAADSDFKVEERGCLGDKCDYNNGCCSGYVCSRTWKWCVLAGPWRR

SEQ ID NO: 899 - protein, 83 aa, Haplopelma huwenum
MKTSMFLTLTGLVLLFVVCYASESEEKEFPKELPSSIFAADSDFKVEERGCLGDKCDYNNGCCSGYVCSRTWKWCVLAGPWRR

SEQ ID NO: 900 - protein, 83 aa, Haplopelma huwenum
MKTSMFLTLTGLVLLFVVCYASESEEKEFPKELLSSIFAADSDFKVEERGCLGDKCDYNNGCCSGYVCSRTWKWCVLAGPWRR

SEQ ID NO: 901 - protein, 83 aa, Haplopelma huwenum
MQTSMFLTLTGLVLLFVVCYASESEEKEFPKELLSSIFAADSDFKEEERGCFGYKCDYYKGCCSGYVCSPTWKWCVRPGPGRR

SEQ ID NO: 902 - protein, 83 aa, Haplopelma huwenum
MKTSMFLTLTGLVLLFVVCYASESEEKEFPKELLSSIFAADSDFKVEERGCLGDKCDYNNGCCSGYVCSRTWKWCVLAGPWCR

SEQ ID NO: 903 - protein, 83 aa, Haplopelma huwenum
MKTSMFLTLTGLVLLFVVCYASESEEKEFPKELLSSIFAADSDFKVEERGCLGDKCDYNNGCCSGYVCPRTWKWCVLAGPWRR

SEQ ID NO: 904 - protein, 84 aa, Haplopelma huwenum
MKVTLIAILTCAAVLVLHTTAAEELEESQLMEVGMPDTELAAVDEERLFECSFSCEIEKEGDKPCKKKKCKGGWKCKFNMCVKV

SEQ ID NO: 905 - protein, 85 aa, Haplopelma huwenum
MKVTLIAILTCAAVLVLHTTAAEELEAESQLMEVGMPDTESAAVDEERLFECSFSCEIEKEGDKPCKKKKCKGGWKCKFNMCVKV

SEQ ID NO: 906 - protein, 84 aa, Haplopelma huwenum
MKVTLIAILTCAAVLVLHTTAAEELEESQLMEVGMPDTELAAVDEERPFECSFSCEIEKEGDKPCKKKKCKGGWKCKFNMCVKV

SEQ ID NO: 907 - protein, 84 aa, Haplopelma huwenum
MKVTLIAFLTCAAVLVLHTTAAEELEAESQLMEVGMPDTELAAVDEERLFECSISCEIEKKGESCKPKKCKGGWKCKFNMCVKV

SEQ ID NO: 908 - protein, 84 aa, Haplopelma huwenum
MKVTLIAILTCAAVLVLHTTAAEELEAESQLMEVGMPDTELAAVDEERLFECSISCEIEKKGESCKPKKCKGGWKCKFNMCVKV

SEQ ID NO: 909 - protein, 83 aa, Haplopelma huwenum; identical to SEQ ID NO: 823

SEQ ID NO: 910 - protein, 88 aa, Haplopelma huwenum
MGIARILSAVLFLSVLFVVTFPALLSADHRDGRIDTCRLPSDRGRCKASFERWYFNGRTCAKFIYGGCGGNGNKFPTQEACMKRCAKA

SEQ ID NO: 911 - protein, 85 aa, Haplopelma huwenum
MKVTLIAILTCAAVLVLHTTAAEELEAESQLMEVGMPDTELAAVDEERLFECSFSCEIEKEGDKPCKKKKCKGGWKCKFNMCVKF

SEQ ID NO: 912 - protein, 88 aa, Haplopelma huwenum
MGIARILSAVLFLSVLFVVTFPALLSADHHDGRIDTCRLPSDRGRCKASFERWYFNGRTCAKFIYGGCGGNGNKFPTQEACMKRCAKA

SEQ ID NO: 913 - protein, 78 aa, Hadronyche infensa; identical to SEQ ID NO: 614

SEQ ID NO: 914 - protein, 78 aa, Hadronyche infensa; identical to SEQ ID NO: 620

SEQ ID NO: 915 - protein, 79 aa, Hadronyche infensa; identical to SEQ ID NO: 608

SEQ ID NO: 916 - protein, 79 aa, Hadronyche infensa; identical to SEQ ID NO: 610

SEQ ID NO: 917 - protein, 79 aa, Hadronyche infensa
MNTATGFIVLLVLATVIGCISTDFQGGFEPYEEEDAERIFRRSPTCIPTGQPCPYNENCCSQSCTYKANENGNQVKRCD

SEQ ID NO: 918 - protein, 79 aa, Hadronyche infensa
MNTATGFIVLLVLATVIGCISADFQGGFEPYEEEDAQRIFRRSPTCIPTGQPCPYNENCCSQSCTYKANENGNQVKRCD

SEQ ID NO: 919 - protein, 78 aa, Hadronyche infensa; identical to SEQ ID NO: 612

SEQ ID NO: 920 - protein, 79 aa, Hadronyche infensa; identical to SEQ ID NO: 606

SEQ ID NO: 921 - protein, 79 aa, Hadronyche infensa; identical to SEQ ID NO: 604

SEQ ID NO: 922 - protein, 79 aa, Hadronyche infensa
MNTATGFIVLLVLATVIGCISADFQGGFEPYEEEDAERIFRRSPTCIPTGQPCPYNENCCSQSCTYKTNENGNQVKGCD

SEQ ID NO: 923 - protein, 78 aa, Hadronyche infensa; identical to SEQ ID NO: 616

SEQ ID NO: 924 - protein, 78 aa, Hadronyche infensa; identical to SEQ ID NO: 622

SEQ ID NO: 925 - protein, 78 aa, Hadronyche infensa; identical to SEQ ID NO: 618

SEQ ID NO: 926 - protein, 37 aa, Heriaeus melloteei
GCIPYGKTCEFWSGPWCCAGKCKLNVWSMTLSCTRNF

SEQ ID NO: 927 - protein, 40 aa, Heriaeus melloteei
GCIPSFGECAWFSGESCCTGICKWVFFTSKFMCRRVWGKD

SEQ ID NO: 928 - protein, 35 aa, Agelena orientalis
KGCLPRNRFCNALSGPRCCSGLRCKELSIWASKCL

SEQ ID NO: 929 - protein, 35 aa, Agelena orientalis
GGCLPHNRFCNALSGPRCCSGLTCKELNIWASKCL

SEQ ID NO: 930 - protein, 29 aa, Eucratoscelus constrictus
YCQKFLWTCDTERKCCEDMVCELWCKLEK

SEQ ID NO: 931 - protein, 86 aa, Haplopelma huwenum
MKASMFLALAGLVLLFVVCYASESEEKEFSNELLSSVLAVDDNSKGEERECLEIFKACNPSNDQCCKSSKLVCSRKTRWCKYQIGK

SEQ ID NO: 932 - protein, 86 aa, Haplopelma huwenum
MKASMFLALAGLVQLFVVCYASESEEKEFSNELLSSVLAVDDNSKGEERECLEIFKACNPSNDQCCKSSKLVCSRKTRWCKYQIGK

SEQ ID NO: 933 - protein, 81 aa, Haplopelma huwenum
MKASMFLAFAGLVLLFVVCYASESEEKEFPRELISKIFAVDDFKGEERACKGVFDACTPGKNECCPNRVCSDEHKWCKWKL

SEQ ID NO: 934 - protein, 86 aa, Chilobrachys jingzhao
MKVSLLITLAVLGVMFVWASAAELQERGSDQKDSPAWLKSMERIFQSEERECKKMFGGCTVHSDCCAHLGCKPTLKYCAWDGTFGK

SEQ ID NO: 935 - protein, 83 aa, Chilobrachys jingzhao
MKGSAFAIILGLVVLCACSFAEDEQDQFASPNELLRSMFLESRHELIPEVEGRYCQKWMWTCDSERKCCEGYVCELWCKYNMG

SEQ ID NO: 936 - protein, 63 aa, Chilobrachys jingzhao
MKNTSILFILGLALLLVLAFEVQVGESDGECGGFWWKCGSGKPACCPKYVCSPKWGLCNFPMP

SEQ ID NO: 937 - protein, 86 aa, Chilobrachys jingzhao
MKVSVLITLAVLGVMFVWASAAELEERGSDHRDSPAWLKSMERIFQSEERECRKMFGGCSVHSDCCAHLGCKPTLKYCAWDGTFGK

SEQ ID NO: 938 - protein, 77 aa, Chilobrachys jingzhao
MKTSVLLVILGIAAITVQCTASESVEQDSLRTFVDTVLGWNAEMASEARCGGWMAKCADSDDCCETFHCTRFNVCGK

SEQ ID NO: 939 - protein, 77 aa, Chilobrachys jingzhao
MKTSVLLVILGIAAITVQCTASESVEQDSLRTFVDAVLGWNAEMASEARCGGWMAKCADSDDCCETFHCTRFNVCGK

SEQ ID NO: 940 - protein, 77 aa, Chilobrachys jingzhao
MKTSVLLVILGIAAITVQCTASESVEQDSLRTFVDAVLGWNAEMASEARCGGWMAKCADSDDCCEAFHCTRFNVCGK

SEQ ID NO: 941 - protein, 77 aa, Chilobrachys jingzhao
MNTSDPPAVLRIAAITLLCTASESVEQNPLIPFENAVLGSYAKMASEKRCDGWMAKCPDRDDCCETFHCTRFNARGN

SEQ ID NO: 942 - protein, 87 aa, Chilobrachys jingzhao
MKVLVLITLAVLGAMFVWTSAAELEERGSDQRDSPAWVKSMERIFQSEERACREWLGGCSKDADCCAHLECRKKWPYHCVWDWTVRK

SEQ ID NO: 943 - protein, 78 aa, Chilobrachys jingzhao
MKTSVLVTVLGLAVISVLCSASQDEEQDMYDELLSAVFEVNDELQSEARCGEKNDRCKTNQDCCSGFRCTKFRRCGRR

SEQ ID NO: 944 - protein, 85 aa, Chilobrachys jingzhao
MKVSVLITLAVLGVMFVWASAAELEERGSDQRDSPAWLKSMERIFQSEERECRKMFGGCSVDSDCCAHLGCKPTLKYCAWDLTFP

SEQ ID NO: 945 - protein, 86 aa, Chilobrachys jingzhao
MKVSVLITLAVLGVMFVWTSAAELEERGSDQRDSPAWLKSMERIFQSEERECRKMFGGCSVDSDCCAHLGCKPTLKYCAWDGTFGK

SEQ ID NO: 946 - protein, 86 aa, Chilobrachys jingzhao
MKASVLITLAVLGVMFVWASAAELEERGSDQRDSPAWLKSMERIFQSEERECRKMFGGCSVDSDCCAHLGCKPTLKYCAWDGTFGK

SEQ ID NO: 947 - protein, 86 aa, Chilobrachys jingzhao
MKVSVVITLAVLGVMFVWASAAELEERGSDQRDSPAWLKSMERIFQSEERECRKMFGGCSVDSDCCAHLGCKPTLKYCAWDGTFGK

SEQ ID NO: 948 - protein, 86 aa, Chilobrachys jingzhao
MKVSVLITLAVLGVMFVWASAAELEERGSDQRDSPAWLKSMERIFRSEERECRKMFGGCSVDSDCCAHLGCKPTLKYCAWDGTFGK

SEQ ID NO: 949 - protein, 86 aa, Chilobrachys jingzhao
MKVSVLITLAVLGVMFVWASAAELEERGSDQRDSPAWLKSMERIFQSEERECRKMFGGCSVDSDCCAHLGCKPTLKYCAWDGTFGK

SEQ ID NO: 950 - protein, 83 aa, Chilobrachys jingzhao
MKGSAFAIILGLVVLCACSFAEDEQDQFASPNELLRSMFLESRHELIPEVEGRYCQKWMWTCDSERKCCEGYVCELWCKYNLG

SEQ ID NO: 951 - protein, 62 aa, Chilobrachys jingzhao; identical to SEQ ID NO: 734

SEQ ID NO: 952 - protein, 62 aa, Chilobrachys jingzhao
MKTSILFVIFSLALVFALSPATEIEETDRACGQFWWKCGEGKPPCCANFACKIGLYLCIWSP

SEQ ID NO: 953 - protein, 63 aa, Chilobrachys jingzhao
MKSTSILFILGLALLLVLAFEVQVGESDGECGGFWWKCGSGKPACCPKYVCSPKWGLCNFPMP

SEQ ID NO: 954 - protein, 77 aa, Chilobrachys jingzhao
MKTSVLLVILGIAAITVQCTASESVKQDSLRTFVDAVLGWNAEMASEARCGGWMAKCADSDDCCETFHCTRFNVCGK

SEQ ID NO: 955 - protein, 50 aa, Chilobrachys jingzhao
MYDEILSAFFEVNDELQSEARCGEKNDRCKTNQDCCSGFRCTKFRRCGRR

SEQ ID NO: 956 - protein, 35 aa, Grammostola rosea
GCLEFWWKCNPNDDKCCRPKLKCSKLFKLCNFSSG

SEQ ID NO: 957 - protein, 39 aa, Aphonopelma sp.
LFECVLSCDIKKNGKPCKPKGEKKCSGGWRCKINFCLKV

SEQ ID NO: 958 - protein, 78 aa, Atrax robustus; identical to SEQ ID NO: 598

SEQ ID NO: 959 - protein, 98 aa, Hadronyche versuta
MKFSKLSLTLALILTQAIFVLCGKINEDFMKNDLESQALHDEIRKPIDSENPDTERLLDCLLDNRVCSSDKDCCGMTPSCTMGLCVPSVGGLVGGILG

SEQ ID NO: 960 - protein, 98 aa, Atrax robustus; identical to SEQ ID NO: 535

SEQ ID NO: 961 - protein, 98 aa, Hadronyche versuta; identical to SEQ ID NO: 537

SEQ ID NO: 962 - protein, 98 aa, Hadronyche versuta; identical to SEQ ID NO: 538

SEQ ID NO: 963 - protein, 98 aa, Hadronyche versuta; identical to SEQ ID NO: 539

SEQ ID NO: 964 - protein, 98 aa, Hadronyche versuta; identical to SEQ ID NO: 540

SEQ ID NO: 965 - protein, 93 aa, Hadronyche versuta; identical to SEQ ID NO: 541

SEQ ID NO: 966 - protein, 98 aa, Hadronyche versuta; identical to SEQ ID NO: 543

SEQ ID NO: 967 - protein, 98 aa, Atrax robustus; identical to SEQ ID NO: 542

SEQ ID NO: 968 - protein, 98 aa, Hadronyche versuta; identical to SEQ ID NO: 544

SEQ ID NO: 969 - protein, 98 aa, Hadronyche versuta; identical to SEQ ID NO: 549

SEQ ID NO: 970 - protein, 96 aa, Atrax robustus; identical to SEQ ID NO: 550

SEQ ID NO: 971 - protein, 98 aa, Hadronyche versuta; identical to SEQ ID NO: 547

SEQ ID NO: 972 - protein, 98 aa, Hadronyche versuta; identical to SEQ ID NO: 548

SEQ ID NO: 973 - protein, 93 aa, Hadronyche versuta; identical to SEQ ID NO: 546

SEQ ID NO: 974 - protein, 97 aa, Hadronyche versuta; identical to SEQ ID NO: 545

SEQ ID NO: 975 - protein, 96 aa, Atrax robustus; identical to SEQ ID NO: 551

SEQ ID NO: 976 - protein, 101 aa, Hadronyche versuta; identical to SEQ ID NO: 552

SEQ ID NO: 977 - protein, 101 aa, Hadronyche versuta; identical to SEQ ID NO: 553

SEQ ID NO: 978 - protein, 101 aa, Hadronyche versuta; identical to SEQ ID NO: 554

SEQ ID NO: 979 - protein, 101 aa, Hadronyche versuta; identical to SEQ ID NO: 557

SEQ ID NO: 980 - protein, 101 aa, Hadronyche versuta; identical to SEQ ID NO: 558

SEQ ID NO: 981 - protein, 100 aa, Hadronyche infensa
MKFSKLSLTLALILTQALFVLCGKINEDFMEHGLESHALHDEIRKPITEKADAERLVDCVVNTLGCSSDKDCCGMTPSCTLGICAPSVGGLVGGLLGRAL

SEQ ID NO: 982 - protein, 101 aa, Hadronyche infensa; identical to SEQ ID NO: 556

SEQ ID NO: 983 - protein, 100 aa, Hadronyche versuta; identical to SEQ ID NO: 559

SEQ ID NO: 984 - protein, 97 aa, Atrax robustus; identical to SEQ ID NO: 560

SEQ ID NO: 985 - protein, 97 aa, Atrax robustus; identical to SEQ ID NO: 561

SEQ ID NO: 986 - protein, 101 aa, Hadronyche versuta; identical to SEQ ID NO: 562

SEQ ID NO: 987 - protein, 101 aa, Hadronyche versuta; identical to SEQ ID NO: 563

SEQ ID NO: 988 - protein, 101 aa, Hadronyche versuta; identical to SEQ ID NO: 564

SEQ ID NO: 989 - protein, 101 aa, Hadronyche versuta; identical to SEQ ID NO: 565

SEQ ID NO: 990 - protein, 101 aa, Hadronyche versuta; identical to SEQ ID NO: 566

SEQ ID NO: 991 - protein, 101 aa, Hadronyche versuta; identical to SEQ ID NO: 567

SEQ ID NO: 992 - protein, 95 aa, Hadronyche versuta; identical to SEQ ID NO: 568

SEQ ID NO: 993 - protein, 29 aa, Eucratoscelus constrictus
YCQKFLWTCDTERKCCEDMVCELWCKYKE

SEQ ID NO: 994 - protein, 29 aa, Eucratoscelus constrictus
YCQFKMWTCDSERKCCEDMVCRLWCKLNL

SEQ ID NO: 995 - protein, 63 aa, Agelena orientalis
LLLISAMVGSMIAAVPEEESLQLSEDERGGCLPHNRFCNALSGPRCCSGLTCKELNIWASKCL

SEQ ID NO: 996 - protein, 27 aa, Conus amadis
  SITE 27: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
CKQAGESCDIFSQNCCVGTCAFICIEX

SEQ ID NO: 997 - protein, 28 aa, Conus catus
  SITE 28: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
CKSKGAKCSKLMYDCCSGSCSGTVGRCX

SEQ ID NO: 998 - protein, 33 aa, Conus ermineus
  SITE 6: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
  SITE 33: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
DDCIKXYGFCSLPILKNGLCCSGACVGVCADLX

SEQ ID NO: 999 - protein, 33 aa, Conus ermineus; identical to SEQ ID NO: 998
  SITE 6: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
  SITE 33: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.

SEQ ID NO: 1000 - protein, 34 aa, Conus geographus
ACSGRGSRCPPQCCMGLRCGRGNPQKCIGAHEDV

SEQ ID NO: 1001 - protein, 23 aa, Conus geographus
  SITE 23: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
RDCCTPPRKCKDRRCKPMKCCAX

SEQ ID NO: 1002 - protein, 28 aa, Conus geographus
  SITE 28: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
CKSPGSSCSPTSYNCCRSCNPYTKRCYX

SEQ ID NO: 1003 - protein, 23 aa, Conus geographus
  SITE 23: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
RDCCTPPKKCKDRQCKPQRCCAX

SEQ ID NO: 1004 - protein, 23 aa, Conus geographus
  SITE 23: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
RDCCTPPKKCKDRQCKPQRCCAX

SEQ ID NO: 1005 - protein, 28 aa, Conus geographus
  SITE 28: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
CKSPGSSCSPTSYNCCRSCNPYTKRCYX

SEQ ID NO: 1006 - protein, 28 aa, Conus geographus
  SITE 28: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
CKSPGSSCSPTSYNCCRSCNPYTKRCYX

SEQ ID NO: 1007 - protein, 23 aa, Conus geographus
  SITE 23: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
RDCCTPPKKCKDRQCKPQRCCAX

SEQ ID NO: 1008 - protein, 23 aa, Conus geographus
  SITE 23: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
RDCCTPPKKCKDRQCKPQRCCAX

SEQ ID NO: 1009 - protein, 28 aa, Conus gloriamaris
  SITE 28: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
SCNNSCQSHSDCASHCICTFRGCGAVNX

SEQ ID NO: 1010 - protein, 17 aa, Conus kinoshitai
  SITE 17: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
CCNCSSKWCRDHSRCCX

SEQ ID NO: 1011 - protein, 26 aa, Conus magus
  SITE 26: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
CKGKGAKCSRLMYDCCTGSCRSGKCX

SEQ ID NO: 1012 - protein, 26 aa, Conus magus
  SITE 26: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
CKGKGAKCSRLMYDCCTGSCRSGKCX

SEQ ID NO: 1013 - protein, 26 aa, Conus magus
  SITE 26: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
CKGKGAKCSRLMYDCCTGSCRSGKCX

SEQ ID NO: 1014 - protein, 26 aa, Conus magus
  SITE 26: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
CKGKGAKCSRLMYDCCTGSCRSGKCX

SEQ ID NO: 1015 - protein, 26 aa, Conus magus
  SITE 26: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
CKGKGAKCSRLMYDCCTGSCRSGKCX

SEQ ID NO: 1016 - protein, 31 aa, Conus marmoreus
ACSKKWEYCIVPILGFVYCCPGLICGPFVCV

SEQ ID NO: 1017 - protein, 15 aa, Conus marmoreus
DWEYHAHPKPNSFWT

SEQ ID NO: 1018 - protein, 16 aa, Conus marmoreus
CCAPSACRLGCRPCCR

SEQ ID NO: 1019 - protein, 16 aa, Conus marmoreus
CCAPSACRLGCRPCCR

SEQ ID NO: 1020 - protein, 28 aa, Conus purpurascens
  SITE 28: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
CRIPNQKCFQHLDDCCSRKCNRFNKCVX

SEQ ID NO: 1021 - protein, 25 aa, Conus purpurascens
  SITE 25: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
HPPCCLYGKCRRYPGCSSASCCQRX

SEQ ID NO: 1022 - protein, 28 aa, Conus purpurascens
  SITE 28: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
CRIPNQKCFQHLDDCCSRKCNRFNKCVX

SEQ ID NO: 1023 - protein, 25 aa, Conus purpurascens
  SITE 25: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
HPPCCLYGKCRRYPGCSSASCCQRX

SEQ ID NO: 1024 - protein, 25 aa, Conus purpurascens
  SITE 25: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
GPPCCLYGSCRPFPGCYNALCCRKX

SEQ ID NO: 1025 - protein, 23 aa, Conus purpurascens
  SITE 23: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
QRLCCGFPKSCRSRQCKPHRCCX

SEQ ID NO: 1026 - protein, 22 aa, Conus stercusmuscarum
QRCCNGRRGCSSRWCRDHSRCC

SEQ ID NO: 1027 - protein, 26 aa, Conus striatus
  SITE 26: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
CKAAGKPCSRIAYNCCTGSCRSGKCX

SEQ ID NO: 1028 - protein, 27 aa, Conus striatus
  SITE 27: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
CKLKGQSCRKTSYDCCSGSCGRSGKCX

SEQ ID NO: 1029 - protein, 21 aa, Conus striatus
  SITE 21: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
QNCCNGGCSSKWCRDHARCCX

SEQ ID NO: 1030 - protein, 26 aa, Conus textile
CKQADEPCDVFSLDCCTGICLGVCMW

SEQ ID NO: 1031 - protein, 27 aa, Conus textile
WCKQSGEMCNLLDQNCCDGYCIVLVCT

SEQ ID NO: 1032 - protein, 30 aa, Conus tulipa
SCSGRDSRCPPVCCMGLMCSRGKCVSIYGE

SEQ ID NO: 1033 - protein, 23 aa, Conus tulipa
  SITE 23: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
RHGCCKGPKGCSSRECRPQHCCX

SEQ ID NO: 1034 - protein, 21 aa, Striated cone
  SITE 21: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
QNCCNGGCSSKWCRDHARCCX

SEQ ID NO: 1035 - protein, 24 aa, Hordeum vulgare
MANKHLSLSLFLVLLGLSASLASG

SEQ ID NO: 1036 - protein, 238 aa, Aequorea victoria; identical to SEQ ID NO: 7

SEQ ID NO: 1037 - protein, 4 aa, Pisum sativum
IGER

SEQ ID NO: 1038 - protein, 305 aa, Hadronyche versuta; identical to SEQ ID NO: 11

SEQ ID NO: 1039 - protein, 282 aa, Hadronyche versuta; identical to SEQ ID NO: 10

SEQ ID NO: 1040 - protein, 61 aa, Hadronyche versuta; identical to SEQ ID NO: 9

SEQ ID NO: 1041 - protein, 38 aa, Hadronyche versuta; identical to SEQ ID NO: 8

SEQ ID NO: 1042 - protein, 41 aa, Hadronyche versuta; identical to SEQ ID NO: 5

SEQ ID NO: 1043 - protein, 32 aa, Phoneutria nigriventer; identical to SEQ ID NO: 774

SEQ ID NO: 1044 - protein, 31 aa, Phoneutria nigriventer; identical to SEQ ID NO: 787

SEQ ID NO: 1045 - protein, 33 aa, Phoneutria nigriventer; identical to SEQ ID NO: 760

SEQ ID NO: 1046 - protein, 35 aa, Allagelena opulenta; identical to SEQ ID NO: 805

SEQ ID NO: 1047 - protein, 68 aa, Cupiennius salei
KDDKNCIPKHHECTNDKKNCCKKGLTKMKCKCFTVADAKGATSERCACDSSLLQKFGFTGLHIIKGLF

SEQ ID NO: 1048 - protein, 80 aa, Calisoga sp.
MKYFVVFCVLIIAVAAFTSAAEDGEVFEENPLEFPKTIQKRCISARYPCSNSKDCCSGNCGTFWTCYIRKDPCSKECLAP

SEQ ID NO: 1049 - protein, 39 aa, Calisoga sp.
CISARYPCSNSKDCCSGNCGTFWTCFIRKDPCSKECLAP

SEQ ID NO: 1050 - protein, 39 aa, Calisoga sp.
CISARYPCSNSKDCCSGSCGIFWTCYLRKDPCSKECLAP

SEQ ID NO: 1051 - protein, 82 aa, Plectreurys tristis
MKHLIFSSALVCALVVCTFAEEQVNVPFLPDERAVKCIGWQETCNGNLPCCNECVMCECNIMGQNCRCNHPKATNECESRRR

SEQ ID NO: 1052 - protein, 61 aa, Plectreurys tristis
EEQVNVPFLPDERAVKCIGWQETCNGQLPCCDGCVMCECNIMGQNCRCNHPKMTSECGSRR

SEQ ID NO: 1053 - protein, 79 aa, Plectreurys tristis
HLILASALICALVVCTFAEEQVNVPFLPDEREVKCIGWQEYCRGNLPCCDDCVMCECNIMGQNCRCNHPRITSECGSRR

SEQ ID NO: 1054 - protein, 45 aa, Plectreurys tristis
AVKCIGWQETCNGNLPCCNECVMCECNIMGQNCRCNHPKATNECE

SEQ ID NO: 1055 - protein, 46 aa, Plectreurys tristis
AVKCIGWQETCNGKLPCCDGCVMCECNIMGQNCRCNHPKATSECES

SEQ ID NO: 1056 - protein, 31 aa, Coremiocnemis valida; identical to SEQ ID NO: 857

SEQ ID NO: 1057 - protein, 85 aa, Haplopelma huwenum; identical to SEQ ID NO: 817

SEQ ID NO: 1058 - protein, 84 aa, Haplopelma huwenum; identical to SEQ ID NO: 904

SEQ ID NO: 1059 - protein, 85 aa, Haplopelma huwenum; identical to SEQ ID NO: 905

SEQ ID NO: 1060 - protein, 37 aa, Haplopelma huwenum; identical to SEQ ID NO: 818

SEQ ID NO: 1061 - protein, 85 aa, Haplopelma huwenum; identical to SEQ ID NO: 862

SEQ ID NO: 1062 - protein, 84 aa, Haplopelma huwenum; identical to SEQ ID NO: 906

SEQ ID NO: 1063 - protein, 85 aa, Haplopelma huwenum; identical to SEQ ID NO: 911

SEQ ID NO: 1064 - protein, 85 aa, Haplopelma huwenum; identical to SEQ ID NO: 872

SEQ ID NO: 1065 - protein, 83 aa, Haplopelma huwenum; identical to SEQ ID NO: 823

SEQ ID NO: 1066 - protein, 84 aa, Haplopelma huwenum; identical to SEQ ID NO: 907

SEQ ID NO: 1067 - protein, 84 aa, Haplopelma huwenum; identical to SEQ ID NO: 908

SEQ ID NO: 1068 - protein, 83 aa, Haplopelma huwenum; identical to SEQ ID NO: 823

SEQ ID NO: 1069 - protein, 84 aa, Haplopelma huwenum; identical to SEQ ID NO: 870

SEQ ID NO: 1070 - protein, 70 aa, Agelena orientalis; identical to SEQ ID NO: 806

SEQ ID NO: 1071 - protein, 35 aa, Allagelena opulenta; identical to SEQ ID NO: 805

SEQ ID NO: 1072 - protein, 63 aa, Cupiennius salei
SDCTLRNHDCTDDRHSCCRSKMFKDVCTCFYPSQAKKELCTCQQPKHLKYIEKGLQKAKDYAT

SEQ ID NO: 1073 - protein, 88 aa, Cupiennius salei
MKVAILILSILVLAVASETIEEYRDDFAVEELERATCAGQDKPCKETCDCCGERGECVCALSYEGKYRCICRQGNFLIAWHKLASCKK

SEQ ID NO: 1074 - protein, 37 aa, Phoneutria nigriventer
CNSKGTPCTNADECCGGKCAYNVWNCIGGGCSKTCGY

SEQ ID NO: 1075 - protein, 46 aa, Apomastus schlingeri
KECMTDGTVCYIHNHNDCCGSCLCSNGPIARPWEMMVGNCMCGPKA

SEQ ID NO: 1076 - protein, 46 aa, Segestria florentina
KECMADETVCYIHNHNNCCGSCLCLNGPYARPWEMLVGNCKCGPKE

SEQ ID NO: 1077 - protein, 46 aa, Segestria florentina
KECMVDGTVCYIHNHNDCCGSCLCLNGPIARPWEMMVGNCKCGPKA

SEQ ID NO: 1078 - protein, 46 aa, Segestria florentina
KECMVDGTVCYIHNHNDCCGSCLCLNGPIARPWKMMVGNCKCGPKA

SEQ ID NO: 1079 - protein, 46 aa, Segestria florentina
KECMVDGTVCYIHNHNDCCGSCLCPNGPLARPWEMLVGNCKCGPKA

SEQ ID NO: 1080 - protein, 46 aa, Segestria florentina
KECMTDETVCYIHNHNDCCGSCLCLNGPIARPWEMMVGNCKCGPKA

SEQ ID NO: 1081 - protein, 46 aa, Segestria florentina
KECMADGTVCYIHNHNDCCGSCLCPNGPLARPWEVLVGNCKCGPKA

SEQ ID NO: 1082 - protein, 92 aa, Segestria florentina
KECMADGTVCYIHNHNDCCGSCLCPNGPLARPWEMLVGNCKCGPKAKECMADGTVCYIHNHNDCCGSCLCPNGPLARPWEMLVGNCKCGPKA

SEQ ID NO: 1083 - protein, 87 aa, Haplopelma huwenum; identical to SEQ ID NO: 819

SEQ ID NO: 1084 - protein, 32 aa, Apomastus schlingeri; identical to SEQ ID NO: 851

SEQ ID NO: 1085 - protein, 49 aa, Plectreurys tristis
GCKGFLVKCDSNSECCKTAIVKGKKKQLSCLCGAWGAGCSCSFRCGNRC

SEQ ID NO: 1086 - protein, 32 aa, Phoneutria nigriventer; identical to SEQ ID NO: 790

SEQ ID NO: 1087 - protein, 54 aa, Phoneutria keyserlingi
ATCAGQDKPCKETCDCCGERGECVCGLSYEGKYRCICRQGTFLIAWYKLASCKK

SEQ ID NO: 1088 - protein, 79 aa, Macrothele gigas; identical to SEQ ID NO: 840

SEQ ID NO: 1089 - protein, 29 aa, Macrothele raveni
GCKLTFWKCKNKKECCGWNACALGICMPR

SEQ ID NO: 1090 - protein, 81 aa, Phoneutria nigriventer
MKVAIVFLSLLVLAFASESIEENREEFPVEESARCADINGACKSDCDCCGDSVTCDCYWSDSCKCRESNFKIGMAIRKKFC

SEQ ID NO: 1091 - protein, 42 aa, Missulena bradleyi
CAKKREWCAKTEDCCCPMKCIYAWYNEQSSCQTTFSGMFKKC

SEQ ID NO: 1092 - protein, 37 aa, Pireneitega luctuosa
GCLGEGEKCADWSGPSCCDGFYCSCRSMPYCRCRNNS

SEQ ID NO: 1093 - protein, 37 aa, Pireneitega luctuosa
ACVGDGQRCASWSGPYCCDGYYCSCRSMPYCRCRNNS

SEQ ID NO: 1094 - protein, 36 aa, Pirenitega luctuosa
ADCLNEGDWCADWSGPSCCGEMWCSCPGFGKCRCKK

SEQ ID NO: 1095 - protein, 37 aa, Pireneitega luctuosa
ACATKNQRCASWAGPYCCDGFYCSCRSYPGCMCRPNS

SEQ ID NO: 1096 - protein, 47 aa, Ancylometes sp.
ATCAGQDKPCKVNCDCCGERGECVCGGPCICRQGNVFIAWSKLMTCK

SEQ ID NO: 1097 - protein, 48 aa, Phoneutria nigriventer
CGDINAACKEDCDCCGYTTACDCYWSKSCKCREAAIVIYTAPKKKLTC

SEQ ID NO: 1098 - protein, 82 aa, Phoneutria nigriventer
MKVAIVFLSLLVLAFASESIEENREEFPVEESARCGDINAACKEDCDCCGYTTACDCYWSKSCKCREAAIVIYTAPKKKLTC

SEQ ID NO: 1099 - protein, 48 aa, Phoneutria nigriventer
CGDINAACKEDCDCCGYTTACDCYWSSSCKCREAAIVIYTAPKKKLTC

SEQ ID NO: 1100 - protein, 82 aa, Phoneutria nigriventer
MKVAILFLSILVLAVASESIEESRDDFAVEELGRATCAGQDQPCKETCDCCGERGECVCGGPCICRQGYFWIAWYKLANCKK

SEQ ID NO: 1101 - protein, 49 aa, Phoneutria nigriventer
ATCAGQDQTCKVTCDCCGERGECVCGGPCICRQGNFLIAAYKLASCKCK

SEQ ID NO: 1102 - protein, 82 aa, Phoneutria nigriventer
MKVAILFLSILVLAVASESIEESRDDFAVEELGRATCAGQDQTCKVTCDCCGERGECVCGGPCICRQGNFLIAWYKLASCKK

SEQ ID NO: 1103 - protein, 47 aa, Phoneutria reidyi
GTCAGQDKPCKETCDCCGERGQCVCEGPCICRQGYFWIAAYKLGNCK

SEQ ID NO: 1104 - protein, 42 aa, Atrax robustus
CAKKRNWCGKNEDCCCPMKCIYAWYNQQGSCQTTITGLFKKC

SEQ ID NO: 1105 - protein, 42 aa, Hadronyche versuta
CAKKRNWCGKTEDCCCPMKCVYAWYNEQGSCQSTISALWKKC

SEQ ID NO: 1106 - protein, 42 aa, Hadronyche versuta
CSRSDGWCGKTEDCCCPMKCIKAWYKQNGNCQNTISAIWKNC

SEQ ID NO: 1107 - protein, 42 aa, Illawara wisharti
CAKKRNWCGKNEDCCCPMKCIYAWYNQQGSCQSTITGLFKKC

SEQ ID NO: 1108 - protein, 105 aa, Macrothele gigas
MKTLVIACVALVLVVVHGEVIEEVNEKQLQESVEEKYSLLQRLEKLDEAITAEENRNSRVRRCGSKRAWCKEKKDCCCGYNCVYAWYNQQSSCERKWKYLFTGEC

SEQ ID NO: 1109 - protein, 70 aa, Macrothele gigas
MKILEKALLENDSAAEEESRNLRTKRCARKRAWCEKTENCCCPMKCIYAWYNGQSSCDHTISTIWTSCPK

SEQ ID NO: 1110 - protein, 37 aa, Hadronyche formidabilis; identical to SEQ ID NO: 629

SEQ ID NO: 1111 - protein, 36 aa, Hadronyche versuta
TICTGADRPCAACCPCCPGTSCQGPESNGVVYCRNF

SEQ ID NO: 1112 - protein, 36 aa, Hadronyche versuta
TICTGADRPCAACCPCCPGTSCQGPEPNGVSYCRND

SEQ ID NO: 1113 - protein, 37 aa, Hadronyche versuta
AICTGADRPCAACCPCCPGTSCKAESNGVSYCRKDEP

SEQ ID NO: 1114 - protein, 74 aa, Hadronyche versuta
MNTATCFIVLLDVATVIGGIEAGESDMRKDVMGLFRRAICTGADRPCAACCPCCPGTSCKAESNGVSYCRKDEP

SEQ ID NO: 1115 - protein, 74 aa, Hadronyche versuta
MNTATCFIVLLVVATVIGGIEAGEFDMRKDVMGLFRRAICTGADRPCAACCPCCPGTSCKAESNGVSYCRKDEP

SEQ ID NO: 1116 - protein, 74 aa, Hadronyche versuta
MNTATCFIVFLVVATVIGGIEAGESDMRKDVMGLFRRAICTGADRPCAACCPCCPGTSCKAESNGVSYCRKDEP

SEQ ID NO: 1117 - protein, 74 aa, Hadronyche versuta
MNTATCFIVLLVVATVIGGIEAGESDMRKDVMGLFRRVICTGADSPCAACCPCCPGTSCKAESNGVSYCRKDEP

SEQ ID NO: 1118 - protein, 74 aa, Hadronyche versuta
MNTATCFIVLLVVATVIGGIEAGEFDMRKDVMGLFRRAICPGADRPCAACCPCCPGTSCKAESNGVFYCRKDEP

SEQ ID NO: 1119 - protein, 29 aa, Eucratoscelus constrictus
YCQKFLWTCDTERKCCEDMVCELWCKLEK

SEQ ID NO: 1120 - protein, 29 aa, Eucratoscelus constrictus
YCQKFLWTCDTERKCCEDMVCELWCKYKE

SEQ ID NO: 1121 - protein, 36 aa, Agelenopsis aperta
ECVPENGHCRDWYDECCEGFYCSCRQPPKCICRNNN

SEQ ID NO: 1122 - protein, 37 aa, Agelenopsis aperta; identical to SEQ ID NO: 637

SEQ ID NO: 1123 - protein, 38 aa, Agelenopsis aperta; identical to SEQ ID NO: 638

SEQ ID NO: 1124 - protein, 37 aa, Agelenopsis aperta; identical to SEQ ID NO: 639

SEQ ID NO: 1125 - protein, 37 aa, Agelenopsis aperta; identical to SEQ ID NO: 640

SEQ ID NO: 1126 - protein, 37 aa, Hololena curta; identical to SEQ ID NO: 641

SEQ ID NO: 1127 - protein, 36 aa, Hololena curta; identical to SEQ ID NO: 642

SEQ ID NO: 1128 - protein, 38 aa, Hololena curta; identical to SEQ ID NO: 638

SEQ ID NO: 1129 - protein, 38 aa, Hololena curta; identical to SEQ ID NO: 643

SEQ ID NO: 1130 - protein, 94 aa, Diguetia canities
MKVFVVLLCLSLAAVYALEERLDKDADIMLDSPADMERAKDGDVEGPAGCKKYDVECDSGECCQKQYLWYKWRPLDCRCLKSGFFSSKCVCRDV

SEQ ID NO: 1131 - protein, 58 aa, Diguetia canities
AKDGDVKGPAGCMKYKSGDCRGKTCCDQQYLWYKWRNLACRCFTVEVFKKDCWCNDIS

SEQ ID NO: 1132 - protein, 121 aa, Macrothele gigas; identical to SEQ ID NO: 839

SEQ ID NO: 1133 - protein, 38 aa, Macrothele gigas; identical to SEQ ID NO: 838

SEQ ID NO: 1134 - protein, 99 aa, Macrothele gigas; identical to SEQ ID NO: 854

SEQ ID NO: 1135 - protein, 46 aa, Macrothele gigas
GGCIKWNHSCQTTTLKCCGKCVVCYCHTPWGTNCRCDRTRLFCTED

SEQ ID NO: 1136 - protein, 87 aa, Haplopelma huwenum; identical to SEQ ID NO: 819

SEQ ID NO: 1137 - protein, 39 aa, Missulena bradleyi; identical to SEQ ID NO: 762

SEQ ID NO: 1138 - protein, 48 aa, Agelenopsis aperta
KKKCIAKDYGRCKWGGTPCCRGRGCICSIMGTNCECKPRLIMEGLGLA

SEQ ID NO: 1139 - protein, 83 aa, Agelenopsis aperta
MKLCMTLLITAIAVVTFVVATQEESAEFNEVEESREDNCIAEDYGKCTWGGTKCCRGRPCRCSMIGTNCECTPRLIMEGLSFA

SEQ ID NO: 1140 - protein, 83 aa, Agelenopsis aperta; identical to SEQ ID NO: 1139

SEQ ID NO: 1141 - protein, 85 aa, Atrax robustus; identical to SEQ ID NO: 724

SEQ ID NO: 1142 - protein, 37 aa, Atrax robustus; identical to SEQ ID NO: 627

SEQ ID NO: 1143 - protein, 73 aa, Atrax robustus; identical to SEQ ID NO: 602

SEQ ID NO: 1144 - protein, 78 aa, Atrax robustus; identical to SEQ ID NO: 592

SEQ ID NO: 1145 - protein, 78 aa, Atrax robustus; identical to SEQ ID NO: 594

SEQ ID NO: 1146 - protein, 78 aa, Atrax robustus; identical to SEQ ID NO: 600

SEQ ID NO: 1147 - protein, 78 aa, Atrax robustus; identical to SEQ ID NO: 596

SEQ ID NO: 1148 - protein, 76 aa, Atrax robustus; identical to SEQ ID NO: 582

SEQ ID NO: 1149 - protein, 78 aa, Atrax robustus; identical to SEQ ID NO: 598

SEQ ID NO: 1150 - protein, 98 aa, Atrax robustus; identical to SEQ ID NO: 535

SEQ ID NO: 1151 - protein, 98 aa, Atrax robustus; identical to SEQ ID NO: 542

SEQ ID NO: 1152 - protein, 96 aa, Atrax robustus; identical to SEQ ID NO: 550

SEQ ID NO: 1153 - protein, 96 aa, Atrax robustus; identical to SEQ ID NO: 551

SEQ ID NO: 1154 - protein, 97 aa, Atrax robustus; identical to SEQ ID NO: 560

SEQ ID NO: 1155 - protein, 97 aa, Atrax robustus; identical to SEQ ID NO: 561

SEQ ID NO: 1156 - protein, 100 aa, Atrax sp. Illawarra
MKFSKLSITLAVILTQAVFVLCGMKNEDFMEKGLESNELHDAIKKPVNSGKPDTERLLDCVLSRVCSPDANCCGLTPICKMGLCVPKVGGLLGGLLGGIL

SEQ ID NO: 1157 - protein, 100 aa, Atrax sp. Illawarra
MKFSKLSITLAVILTQAVFVLCGMKNEDFMEKGLESNELHDAIKKPVNSGKPDTERLLDCVLSRVCSSDANCCGLTPTCKMGLCVPKVGGLLGGLLGGIL

SEQ ID NO: 1158 - protein, 37 aa, Hadronyche formidabilis; identical to SEQ ID NO: 631

SEQ ID NO: 1159 - protein, 36 aa, Hadronyche infensa; identical to SEQ ID NO: 615

SEQ ID NO: 1160 - protein, 78 aa, Hadronyche infensa; identical to SEQ ID NO: 620

SEQ ID NO: 1161 - protein, 78 aa, Hadronyche infensa; identical to SEQ ID NO: 614

SEQ ID NO: 1162 - protein, 37 aa, Hadronyche infensa; identical to SEQ ID NO: 609

SEQ ID NO: 1163 - protein, 79 aa, Hadronyche infensa; identical to SEQ ID NO: 918

SEQ ID NO: 1164 - protein, 79 aa, Hadronyche infensa; identical to SEQ ID NO: 608

SEQ ID NO: 1165 - protein, 79 aa, Hadronyche infensa; identical to SEQ ID NO: 610

SEQ ID NO: 1166 - protein, 79 aa, Hadronyche infensa; identical to SEQ ID NO: 917

SEQ ID NO: 1167 - protein, 37 aa, Hadronyche infensa; identical to SEQ ID NO: 613

SEQ ID NO: 1168 - protein, 78 aa, Hadronyche infensa; identical to SEQ ID NO: 612

SEQ ID NO: 1169 - protein, 37 aa, Hadronyche versuta
SPTCIPSGGPCPYNENCCSQSCTFKENENGNTVKRCD

SEQ ID NO: 1170 - protein, 37 aa, Hadronyche versuta; identical to SEQ ID NO: 767

SEQ ID NO: 1171 - protein, 37 aa, Hadronyche versuta; identical to SEQ ID NO: 769

SEQ ID NO: 1172 - protein, 37 aa, Hadronyche versuta; identical to SEQ ID NO: 601

SEQ ID NO: 1173 - protein, 37 aa, Hadronyche versuta; identical to SEQ ID NO: 771

SEQ ID NO: 1174 - protein, 37 aa, Hadronyche versuta; identical to SEQ ID NO: 772

SEQ ID NO: 1175 - protein, 76 aa, Hadronyche versuta; identical to SEQ ID NO: 582

SEQ ID NO: 1176 - protein, 76 aa, Hadronyche versuta; identical to SEQ ID NO: 580

SEQ ID NO: 1177 - protein, 76 aa, Hadronyche versuta; identical to SEQ ID NO: 584

SEQ ID NO: 1178 - protein, 45 aa, Hadronyche versuta; identical to SEQ ID NO: 589

SEQ ID NO: 1179 - protein, 98 aa, Hadronyche versuta; identical to SEQ ID NO: 959

SEQ ID NO: 1180 - protein, 98 aa, Hadronyche versuta; identical to SEQ ID NO: 537

SEQ ID NO: 1181 - protein, 98 aa, Hadronyche versuta; identical to SEQ ID NO: 538

SEQ ID NO: 1182 - protein, 98 aa, Hadronyche versuta; identical to SEQ ID NO: 539

SEQ ID NO: 1183 - protein, 98 aa, Hadronyche versuta; identical to SEQ ID NO: 540

SEQ ID NO: 1184 - protein, 93 aa, Hadronyche versuta; identical to SEQ ID NO: 541

SEQ ID NO: 1185 - protein, 98 aa, Hadronyche versuta; identical to SEQ ID NO: 543

SEQ ID NO: 1186 - protein, 98 aa, Hadronyche versuta; identical to SEQ ID NO: 544

SEQ ID NO: 1187 - protein, 98 aa, Hadronyche versuta; identical to SEQ ID NO: 548

SEQ ID NO: 1188 - protein, 93 aa, Hadronyche versuta; identical to SEQ ID NO: 546

SEQ ID NO: 1189 - protein, 97 aa, Hadronyche versuta; identical to SEQ ID NO: 545

SEQ ID NO: 1190 - protein, 98 aa, Hadronyche versuta; identical to SEQ ID NO: 549

SEQ ID NO: 1191 - protein, 98 aa, Hadronyche versuta; identical to SEQ ID NO: 547

SEQ ID NO: 1192 - protein, 101 aa, Hadronyche versuta; identical to SEQ ID NO: 552

SEQ ID NO: 1193 - protein, 101 aa, Hadronyche versuta; identical to SEQ ID NO: 553

SEQ ID NO: 1194 - protein, 101 aa, Hadronyche versuta; identical to SEQ ID NO: 557

SEQ ID NO: 1195 - protein, 101 aa, Hadronyche versuta; identical to SEQ ID NO: 554

SEQ ID NO: 1196 - protein, 101 aa, Hadronyche versuta; identical to SEQ ID NO: 558

SEQ ID NO: 1197 - protein, 95 aa, Hadronyche versuta; identical to SEQ ID NO: 568

SEQ ID NO: 1198 - protein, 100 aa, Hadronyche versuta; identical to SEQ ID NO: 559

SEQ ID NO: 1199 - protein, 101 aa, Hadronyche versuta; identical to SEQ ID NO: 562

SEQ ID NO: 1200 - protein, 101 aa, Hadronyche versuta; identical to SEQ ID NO: 563

SEQ ID NO: 1201 - protein, 101 aa, Hadronyche versuta; identical to SEQ ID NO: 566

SEQ ID NO: 1202 - protein, 101 aa, Hadronyche versuta; identical to SEQ ID NO: 567

SEQ ID NO: 1203 - protein, 101 aa, Hadronyche versuta; identical to SEQ ID NO: 564

SEQ ID NO: 1204 - protein, 101 aa, Hadronyche versuta; identical to SEQ ID NO: 565

SEQ ID NO: 1205 - protein, 83 aa, Hadronyche venenata; identical to SEQ ID NO: 878

SEQ ID NO: 1206 - protein, 84 aa, Hadronyche venenata; identical to SEQ ID NO: 879

SEQ ID NO: 1207 - protein, 84 aa, Hadronyche venenata; identical to SEQ ID NO: 880

SEQ ID NO: 1208 - protein, 84 aa, Hadronyche venenata; identical to SEQ ID NO: 881

SEQ ID NO: 1209 - protein, 84 aa, Hadronyche venenata; identical to SEQ ID NO: 882

SEQ ID NO: 1210 - protein, 84 aa, Hadronyche venenata; identical to SEQ ID NO: 883

SEQ ID NO: 1211 - protein, 100 aa, Illawara wisharti; identical to SEQ ID NO: 1156

SEQ ID NO: 1212 - protein, 55 aa, Oxyopes lineatus
AWKCLPKDSTCGDDCDCCEGLHCHCPLRNMLPAILRCSCQSKDDHINTCPKYKKS

SEQ ID NO: 1213 - protein, 44 aa, Plectreurys tristis
ADCSATGDTCDHTKKCCDDCYTCRCGTPWGANCRCDYYKARCDT

SEQ ID NO: 1214 - protein, 39 aa, Aphonopelma sp.; identical to SEQ ID NO: 957

SEQ ID NO: 1215 - protein, 39 aa, Aphonopelma sp.; identical to SEQ ID NO: 777

SEQ ID NO: 1216 - protein, 39 aa, Aphonopelma sp.; identical to SEQ ID NO: 792

SEQ ID NO: 1217 - protein, 39 aa, Brachypelma albiceps; identical to SEQ ID NO: 844

SEQ ID NO: 1218 - protein, 39 aa, Brachypelma albiceps; identical to SEQ ID NO: 848

SEQ ID NO: 1219 - protein, 39 aa, Brachypelma smithi; identical to SEQ ID NO: 792

SEQ ID NO: 1220 - protein, 99 aa, Brachypelma smithi; identical to SEQ ID NO: 868

SEQ ID NO: 1221 - protein, 86 aa, Haplopelma huwenum; identical to SEQ ID NO: 821

SEQ ID NO: 1222 - protein, 47 aa, Anemonia erythraea
GAPCLCANSGPNTRGNDLNGIVWVFGCPSGWHDCHGRAMVGYCCQED

SEQ ID NO: 1223 - protein, 42 aa, Anthopleura elegantissima
GTTCYCGKTIGIYWFGTKTCPSNRGYTGSCGYFLGICCYPVD

SEQ ID NO: 1224 - protein, 42 aa, Anthopleura elegantissima
GTACSCGNSKGIYWFYRPSCPTDRGYTGSCRYFLGTCCTPAD

SEQ ID NO: 1225 - protein, 43 aa, Anemonia sulcata
AAPCFCSGKPGRGDLWILRGTCPGGYGYTSNCYKWPNICCYPH

SEQ ID NO: 1226 - protein, 43 aa, Anemonia sulcata
AAPCFCPGKPDRGDLWILRGTCPGGYGYTSNCYKWPNICCYPH

SEQ ID NO: 1227 - protein, 48 aa, Bunodosoma granulifera
GASCRCDSDGPTSRGNTLTGTLWLIGRCPSGWHNCRGSGPFIGYCCKQ

SEQ ID NO: 1228 - protein, 48 aa, Bunodosoma granulifera
GASCRCDSDGPTSRGDTLTGTLWLIGRCPSGWHNCRGSGPFIGYCCKQ

SEQ ID NO: 1229 - protein, 47 aa, Anthopleura elegantissima
GIACLCDSDGPSVRGNTLSGTYWLAGCPSGWHNCKSSGQLIGACCKQ

SEQ ID NO: 1230 - protein, 47 aa, Anthopleura elegantissima
GVPCLCDSDGPNVRGNTLSGTYWLAGCPSGWHNCKSSGPLIGACCKQ

SEQ ID NO: 1231 - protein, 47 aa, Anemonia sulcata
GVACLCDSDGPNVRGNTLSGTIWLAGCPSGWHNCKAHGPTIGWCCKQ

SEQ ID NO: 1232 - protein, 47 aa, Anthopleura fuscoviridis; identical to SEQ ID NO: 1231

SEQ ID NO: 1233 - protein, 48 aa, Heteractis crispa
ASCKCDDDGPDVRSATFTGTVDFAYCNAGWEKCLAVYTPVASCCRKKK

SEQ ID NO: 1234 - protein, 48 aa, Stoichactis helianthus
AACKCDDEGPDIRTAPLTGTVDLGSCNAGWEKCASYYTIIADCCRKKK

SEQ ID NO: 1235 - protein, 47 aa, Anthopleura elegantissima
GVPCLCDSDGPSVRGNTLSGILWLAGCPSGWHNCKAHGPTIGWCCKQ

SEQ ID NO: 1236 - protein, 47 aa, Anthopleura elegantissima
GVPCLCDSDGPNVRGNTLSGILWLAGCPSGWHNCKAHGPTIGWCCKQ

SEQ ID NO: 1237 - protein, 47 aa, Anemonia sulcata
GVPCLCDSDGPSVRGNTLSGIIWLAGCPSGWHNCKKHGPTIGWCCKQ

SEQ ID NO: 1238 - protein, 48 aa, Anthopleura fuscoviridis
GGVPCLCDSDGPSVRGNTLSGIIWLAGCPSGWHNCKAHGPTIGWCCKQ

SEQ ID NO: 1239 - protein, 48 aa, Heteractis crispa
GTCKCDDDGPDVRTATFTGSTEFANCNESWEKCLAVYTPVASCCRKKK

SEQ ID NO: 1240 - protein, 48 aa, Radianthus paumotensis
ASCKCDDDGPDVRSATFTGTVDFWNCNEGWEKCTAVYTPVASCCRKKK

SEQ ID NO: 1241 - protein, 31 aa, Parasicyonis actinostoloides
AGGKSTCCPCAMCKYTAGCPWGQCAHHCGCS

SEQ ID NO: 1242 - protein, 48 aa, Heteractis crispa
GNCKCDDEGPYVRTAPLTGYVDLGYCNEGWEKCASYYSPIAECCRKKK

SEQ ID NO: 1243 - protein, 48 aa, Radianthus paumotensis
GNCKCDDEGPNVRTAPLTGYVDLGYCNEGWEKCASYYSPIAECCRKKK

SEQ ID NO: 1244 - protein, 48 aa, Heteractis crispa
GNCKCDDEGPNVRTAPLTGYVDLGYCNEGWDKCASYYSPIAECCRKKK

SEQ ID NO: 1245 - protein, 46 aa, Anemonia sulcata
GVPCLCDSDGPSVRGNTLSGILWLAGCPSGWHNCKKHKPTIGWCCK

SEQ ID NO: 1246 - protein, 47 aa, Heteractis crispa
GNCKCDDEGPNVRTAPLTGYVDLGYCNEGWEKCASYYSPIAECCRKK

SEQ ID NO: 1247 - protein, 49 aa, Anthopleura xanthogrammica
GVSCLCDSDGPSVRGNTLSGTLWLYPSGCPSGWHNCKAHGPTIGWCCKQ

SEQ ID NO: 1248 - protein, 49 aa, Anthopleura xanthogrammica
GVPCLCDSDGPRPRGNTLSGILWFYPSGCPSGWHNCKAHGPNIGWCCKK

SEQ ID NO: 1249 - protein, 47 aa, Anthopleura elegantissima; identical to SEQ ID NO: 1235

SEQ ID NO: 1250 - protein, 36 aa, Actinia equina
GCKDNFSANTCKHVKANNNCGSQKYATNCAKTCGKC

SEQ ID NO: 1251 - protein, 37 aa, Bunodosoma granulifera
VCRDWFKETACRHAKSLGNCRTSQKYRANCAKTCELC

SEQ ID NO: 1252 - protein, 48 aa, Bunodosoma caissarum
GVACRCDSDGPTSRGNTLTGTLWLTGGCPSGWHNCRGSGPFIGYCCKK

SEQ ID NO: 1253 - protein, 41 aa, Bunodosoma caissarum
GLPCDCHGHTGTYWLNYYSKCPKGYGYTGRCRYLVGSCCYK

SEQ ID NO: 1254 - protein, 48 aa, Bunodosoma cangicum
GVACRCDSDGPTVRGNSLSGTLWLTGGCPSGWHNCRGSGPFIGYCCKK

SEQ ID NO: 1255 - protein, 35 aa, Stoichactis helianthus
RSCIDTIPKSRCTAFQCKHSMKYRLSFCRKTCGTC

SEQ ID NO: 1256 - protein, 47 aa, Anthopleura xanthogrammica
GVPCLCDSDGPNVRGNTLSGTYWLAGCPSGWHNCKSSGPNIGWCCKK

SEQ ID NO: 1257 - protein, 47 aa, Anthopleura xanthogrammica
GVACLCDADGPSVSGNTLSGILWLAGCPSGWHNCKAHGPTIGWCCKK

SEQ ID NO: 1258 - protein, 47 aa, Anthopleura xanthogrammica
GAACFCDSDGPSVSGNTLSGILWLAGCPSGWHNCKAHGPNIGWCCKK

SEQ ID NO: 1259 - protein, 47 aa, Anthopleura xanthogrammica
GVPCLCDSDGPSVRGNSLSGIIWLFGCPSGWHNCRDHGPTIGWCCKK

SEQ ID NO: 1260 - protein, 49 aa, Anthopleura xanthogrammica
GVSCLCDSDGPSVRGNTLSGILWFYPSGCPSGWHNCKAHGPTIGWCCKQ

SEQ ID NO: 1261 - protein, 48 aa, Bunodosoma cangicum
GVACRCDSDGPTVRGDSLSGTLWLTGGCPSGWHNCRGSGPFIGYCCKK

SEQ ID NO: 1262 - protein, 48 aa, Bunodosoma cangicum
GVACRCDSDGPTVHGDSLSGTLWLTGGCPSGWHNCRGSGPFIGYCCKK

SEQ ID NO: 1263 - protein, 33 aa, Pandinus imperator
GDCLPHLKRCKADNDCCGKKCKRRGTNAEKRCR

SEQ ID NO: 1264 - protein, 32 aa, Centruroides noxius
VACVYRTCDKDCTSRKYRSGKCINNACKCYPY

SEQ ID NO: 1265 - protein, 37 aa, Parabuthus villosus
DEEPKESCSDEMCVIYCKGEEYSTGVCDGPQKCKCSD

SEQ ID NO: 1266 - protein, 37 aa, Parabuthus villosus
DEEPKETCSDEMCVIYCKGEEYSTGVCDGPQKCKCSD

SEQ ID NO: 1267 - protein, 36 aa, Parabuthus granulatus
DEEPKETCSDDMCVIYCKGEEFSTGACDGPQKCKCS

SEQ ID NO: 1268 - protein, 40 aa, Tityus serrulatus
WCSTCLDLACGASRECYDPCFKAFGRAHGKCMNNKCRCYT

SEQ ID NO: 1269 - protein, 40 aa, Tityus trivittatus; identical to SEQ ID NO: 1268

SEQ ID NO: 1270 - protein, 40 aa, Tityus costatus
WCSTCLDLECGASRECYDPCFKAFGRAHGKCMNNKCRCYT

SEQ ID NO: 1271 - protein, 37 aa, Androctonus australis
QNETNKKCQGGSCASVCRRVIGVAAGKCINGRCVCYP

SEQ ID NO: 1272 - protein, 37 aa, Androctonus mauretanicus mauretanicus
QIETNKKCQGGSCASVCRKVIGVAAGKCINGRCVCYP

SEQ ID NO: 1273 - protein, 38 aa, Tityus discrepans
QIDTNVKCSGSSKCVKICIDRYNTRGAKCINGRCTCYP

SEQ ID NO: 1274 - protein, 36 aa, Mesobuthus tamulus
DLIDVKCISSQECWIACKKVTGRFEGKCQNRQCRCY

SEQ ID NO: 1275 - protein, 31 aa, Mesobuthus martensii
AACYSSDCRVKCVAMGFSSGKCINSKCKCYK

SEQ ID NO: 1276 - protein, 37 aa, Mesobuthus tamulus
QFTDVDCSVSKECWSVCKDLFGVDRGKCMGKKCRCYQ

SEQ ID NO: 1277 - protein, 37 aa, Centruroides limbatus
  SITE 37: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
VFIDVSCSVSKECWAPCKAAVGTDRGKCMGKKCRCYX

SEQ ID NO: 1278 - protein, 36 aa, Leiurus quinquestriatus hebraeus
GLIDVRCYDSRQCWIACKKVTGSTQGKCQNKQCRCY

SEQ ID NO: 1279 - protein, 36 aa, Centruroides limbatus
HFIDVKCTTSKECWPPCKAATGKAAGKCMNKKCKCQ

SEQ ID NO: 1280 - protein, 37 aa, Parabuthus transvaalicus
EVDMRCKSSKECLVKCKQATGRPNGKCMNRKCKCYPR

SEQ ID NO: 1281 - protein, 37 aa, Centruroides noxius
TFIDVDCTVSKECWAPCKAAFGVDRGKCMGKKCKCYV

SEQ ID NO: 1282 - protein, 37 aa, Leiurus quinquestriatus hebraeus
QFTNVSCTTSKECWSVCEKLYNTSRGKCMNKKCRCYS

SEQ ID NO: 1283 - protein, 39 aa, Centruroides noxius
TIINVKCTSPKQCSKPCKELYGSSAGAKCMNGKCKCYNN

SEQ ID NO: 1284 - protein, 39 aa, Centruroides margaritatus
TIINVKCTSPKQCLPPCKAQFGQSAGAKCMNGKCKCYPH

SEQ ID NO: 1285 - protein, 38 aa, Centruroides limpidus limpidus
ITINVKCTSPQQCLRPCKDRFGQHAGGKCINGKCKCYP

SEQ ID NO: 1286 - protein, 38 aa, Centruroides noxius
TIINEKCFATSQCWTPCKKAIGSLQSKCMNGKCKCYNG

SEQ ID NO: 1287 - protein, 39 aa, Centruroides limbatus
TVIDVKCTSPKQCLPPCKAQFGIRAGAKCMNGKCKCYPH

SEQ ID NO: 1288 - protein, 34 aa, Centruroides limbatus
  SITE 23: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
TFINVKCTSPKQCLPACKEKFGXAAGKCMNGKCK

SEQ ID NO: 1289 - protein, 36 aa, Centruroides limpidus limpidus
TVIDVKCTSPKQCLPPCKEIYGRHAGAKCMNGKCKC

SEQ ID NO: 1290 - protein, 39 aa, Centruroides elegans
TVINVKCTSPKQCLKPCKDLYGPHAGAKCMNGKCKCYNN

SEQ ID NO: 1291 - protein, 39 aa, Centruroides elegans
TIINVKCTSPKQCLKPCKDLYGPHAGAKCMNGKCKCYNN

SEQ ID NO: 1292 - protein, 39 aa, Centruroides elegans
TIINVKCTSPKQCLLPCKEIYGIHAGAKCMNGKCKCYKI

SEQ ID NO: 1293 - protein, 39 aa, Centruroides elegans
TIINVKCTSPKQCLPPCKEIYGRHAGAKCMNGKCHCSKI

SEQ ID NO: 1294 - protein, 39 aa, Centruroides elegans; identical to SEQ ID NO: 1293

SEQ ID NO: 1295 - protein, 38 aa, Androctonus mauretanicus mauretanicus
GVEINVKCSGSPQCLKPCKDAGMRFGKCMNRKCHCTPK

SEQ ID NO: 1296 - protein, 38 aa, Leiurus quinquestriatus hebraeus
GVPINVSCTGSPQCIKPCKDAGMRFGKCMNRKCHCTPK

SEQ ID NO: 1297 - protein, 38 aa, Leiurus quinquestriatus hebraeus
GVPINVPCTGSPQCIKPCKDAGMRFGKCMNRKCHCTPK

SEQ ID NO: 1298 - protein, 38 aa, Leiurus quinquestriatus hebraeus
GVPINVKCTGSPQCLKPCKDAGMRFGKCINGKCHCTPK

SEQ ID NO: 1299 - protein, 38 aa, Orthochirus scrobiculosus
GVIINVKCKISRQCLEPCKKAGMRFGKCMNGKCHCTPK

SEQ ID NO: 1300 - protein, 38 aa, Buthus sindicus
GVPINVKCRGSPQCIQPCRDAGMRFGKCMNGKCHCTPQ

SEQ ID NO: 1301 - protein, 37 aa, Buthus occitanus tunetanus
VGIPVSCKHSGQCIKPCKDAGMRFGKCMNRKCDCTPK

SEQ ID NO: 1302 - protein, 37 aa, Tityus serrulatus
VFINAKCRGSPECLPKCKEAIGKAAGKCMNGKCKCYP

SEQ ID NO: 1303 - protein, 37 aa, Tityus discrepans
VFINVKCTGSKQCLPACKAAVGKAAGKCMNGKCKCYT

SEQ ID NO: 1304 - protein, 37 aa, Tityus cambridgei
VFINVKCRGSKECLPACKAAVGKAAGKCMNGKCKCYP

SEQ ID NO: 1305 - protein, 31 aa, Leiurus quinquestriatus hebraeus
AFCNLRMCQLSCRSLGLLGKCIGDKCECVKH

SEQ ID NO: 1306 - protein, 31 aa, Androctonus mauretanicus mauretanicus
TVCNLRRCQLSCRSLGLLGKCIGVKCECVKH

SEQ ID NO: 1307 - protein, 31 aa, Mesobuthus tamulus
AFCNLRRCELSCRSLGLLGKCIGEECKCVPY

SEQ ID NO: 1308 - protein, 31 aa, Mesobuthus tamulus
AFCNLRRCELSCRSLGLLGKCIGEECKCVPH

SEQ ID NO: 1309 - protein, 35 aa, Pandinus imperator
LVKCRGTSDCGRPCQQQTGCPNSKCINRMCKCYGC

SEQ ID NO: 1310 - protein, 34 aa, Scorpio maurus palmatus
VSCTGSKDCYAPCRKQTGCPNAKCINKSCKCYGC

SEQ ID NO: 1311 - protein, 34 aa, Heterometrus spinifer
ASCRTPKDCADPCRKETGCPYGKCMNRKCKCNRC

SEQ ID NO: 1312 - protein, 35 aa, Anuroctonus phaiodactylus
QKECTGPQHCTNFCRKNKCTHGKCMNRKCKCFNCK

SEQ ID NO: 1313 - protein, 34 aa, Heterometrus spinifer
IRCSGSRDCYSPCMKQTGCPNAKCINKSCKCYGC

SEQ ID NO: 1314 - protein, 36 aa, Hadrurus gertschi
TGTSCISPKQCTEPCRAKGCKHGKCMNRKCHCMLCL

SEQ ID NO: 1315 - protein, 35 aa, Pandinus imperator
TISCTNEKQCYPHCKKETGYPNAKCMNRKCKCFGR

SEQ ID NO: 1316 - protein, 42 aa, Centruroides elegans
DRDSCVDKSRCAKYGYYQECTDCCKKYGHNGGTCMFFKCKCA

SEQ ID NO: 1317 - protein, 42 aa, Centruroides gracilis
DRDSCVDKSRCAKYGHYQECTDCCKKYGHNGGTCMFFKCKCA

SEQ ID NO: 1318 - protein, 42 aa, Centruroides sculpturatus
DRDSCVDKSRCAKYGYYQECQDCCKKAGHNGGTCMFFKCKCA

SEQ ID NO: 1319 - protein, 42 aa, Centruroides limpidus limpidus
DRDSCVDKSRCSKYGYYQECQDCCKKAGHNGGTCMFFKCKCA

SEQ ID NO: 1320 - protein, 42 aa, Centruroides exilicauda
DRDSCVDKSRCAKYGYYQECQDCCKKAGHSGGTCMFFKCKCA

SEQ ID NO: 1321 - protein, 43 aa, Centruroides noxius
DRDSCVDKSKCGKYGYYQECQDCCKNAGHNGGTCVYYKCKCNP

SEQ ID NO: 1322 - protein, 36 aa, Buthus eupeus
MCMPCFTTRPDMAQQCRACCKGRGKCFGPQCLCGYD

SEQ ID NO: 1323 - protein, 35 aa, Buthus sindicus
RCKPCFTTDPQMSKKCADCCGGKGKGKCYGPQCLC

SEQ ID NO: 1324 - protein, 36 aa, Buthus eupeus
MCMPCFTTDHQTARRCRDCCGGRGRKCFGQCLCGYD

SEQ ID NO: 1325 - protein, 35 aa, Buthus eupeus
MCMPCFTTDHNMAKKCRDCCGGNGKCFGPQCLCNR

SEQ ID NO: 1326 - protein, 35 aa, Buthus eupeus
MCMPCFTTDPNMAKKCRDCCGGNGKCFGPQCLCNR

SEQ ID NO: 1327 - protein, 36 aa, Buthus occitanus tunetanus
  SITE 32: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
  SITE 33: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
VRDAYIAQNYNCVYTCFKNDYCNDICTKNGAXXGYC

SEQ ID NO: 1328 - protein, 38 aa, Leiurus quinquestriatus hebraeus
RCSPCFTTDQQMTKKCYDCCGGKGKGKCYGPQCICAPY

SEQ ID NO: 1329 - protein, 33 aa, Buthus occitanus tunetanus
AEIKVRDGYIVYPNNCVYHCGLDPYCNDLCTGA

SEQ ID NO: 1330 - protein, 33 aa, Scorpio maurus palmatus; identical to SEQ ID NO: 722

SEQ ID NO: 1331 - protein, 36 aa, Buthus sindicus
CGPCFTKDPETEKKCATCCGGIGRCFGPQCLCNRGY

SEQ ID NO: 1332 - protein, 36 aa, Leiurus quinquestriatus quinquestriatus
MCMPCFTTDHQMARKCDDCCGGKGRGKCYGPQCLCR

SEQ ID NO: 1333 - protein, 35 aa, Androctonus mauretanicus mauretanicus
CGPCFTTDPYTESKCATCCGGRGKCVGPQCLCNRI

SEQ ID NO: 1334 - protein, 35 aa, Buthus eupeus
MCMPCFTTDPNMANKCRDCCGGGKKCFGPQCLCNR

SEQ ID NO: 1335 - protein, 35 aa, Hemiscorpius lepturus
IKCTLSKDCYSPCKKETGCPRAKCINRNCKCYGCS

SEQ ID NO: 1336 - protein, 34 aa, Leiurus quinquestriatus hebraeus
CGPCFTTDHQMEQKCAECCGGIGKCYGPQCLCNR

SEQ ID NO: 1337 - protein, 70 aa, Androctonus australis; identical to SEQ ID NO: 645

SEQ ID NO: 1338 - protein, 72 aa, Anuroctonus phaiodactylus
KFIRHKDESFYECGQLIGYQQYCVNACQAHGSKEKGYCKGMAPFGLPGGCYCPKLPSNRVKMCFGALESKCA

SEQ ID NO: 1339 - protein, 61 aa, Buthacus arenicola; identical to SEQ ID NO: 699

SEQ ID NO: 1340 - protein, 65 aa, Bothus occitanus tunetanus; identical to SEQ ID NO: 676

SEQ ID NO: 1341 - protein, 60 aa, Bothus occitanus tunetanus; identical to SEQ ID NO: 701

SEQ ID NO: 1342 - protein, 64 aa, Buthus martensii; identical to SEQ ID NO: 681

SEQ ID NO: 1343 - protein, 64 aa, Buthus martensii; identical to SEQ ID NO: 682

SEQ ID NO: 1344 - protein, 64 aa, Buthus martensii; identical to SEQ ID NO: 683

SEQ ID NO: 1345 - protein, 66 aa, Buthus martensii; identical to SEQ ID NO: 684

SEQ ID NO: 1346 - protein, 72 aa, Buthus martensii
KKNGYAVDSSGKVAECLFNNYCNNECTKVYYADKGYCCLLKCYCFGLADDKPVLDIWDSTKNYCDVQIIDLS

SEQ ID NO: 1347 - protein, 66 aa, buthus occitanus mardochei; identical to SEQ ID NO: 679

SEQ ID NO: 1348 - protein, 65 aa, buthus occitanus mardochei; identical to SEQ ID NO: 680

SEQ ID NO: 1349 - protein, 64 aa, Hottentotta judaica; identical to SEQ ID NO: 677

SEQ ID NO: 1350 - protein, 76 aa, Hottentotta judaicus
KKNGYPLDRNGKTTECSGVNAIAPHYCNSECTKVYYAESGYCCWGACYCFGLEDDKPIGPMKDITKKYCDVQIIPS

SEQ ID NO: 1351 - protein, 61 aa, Hottentotta judaicus; identical to SEQ ID NO: 649

SEQ ID NO: 1352 - protein, 64 aa, Leiurus quinquestriatus hebraeus; identical to SEQ ID NO: 674

SEQ ID NO: 1353 - protein, 63 aa, Leiurus quinquestriatus hebraeus; identical to SEQ ID NO: 702

SEQ ID NO: 1354 - protein, 61 aa, Leiurus quinquestriatus hebraeus; identical to SEQ ID NO: 696

SEQ ID NO: 1355 - protein, 60 aa, Leiurus quinquestriatus hebraeus; identical to SEQ ID NO: 697

SEQ ID NO: 1356 - protein, 70 aa, Leiurus quinquestriatus hebraeus; identical to SEQ ID NO: 694

SEQ ID NO: 1357 - protein, 67 aa, Leiurus quinquestriatus hebraeus; identical to SEQ ID NO: 678

SEQ ID NO: 1358 - protein, 64 aa, Leiurus quinquestriatus hebraeus; identical to SEQ ID NO: 685

SEQ ID NO: 1359 - protein, 66 aa, Leiurus quinquestriatus hebraeus; identical to SEQ ID NO: 686

SEQ ID NO: 1360 - protein, 70 aa, Leiurus quinquestriatus quinquestriatus; identical to SEQ ID NO: 693

SEQ ID NO: 1361 - protein, 61 aa, Leiurus quinquestriatus quinquestriatus; identical to SEQ ID NO: 648

SEQ ID NO: 1362 - protein, 64 aa, Leiurus quinquestriatus quinquestriatus; identical to SEQ ID NO: 675

SEQ ID NO: 1363 - protein, 65 aa, Odonthobuthus doriae
GVRDAYIADDKNCVYTCASNGYCNTECTKNGAESGYCQWIGRYGNACWCIKLPDEVPIRIPGKCR

SEQ ID NO: 1364 - protein, 61 aa, Tityus serrulatus
KEGYLMDHEGCKLSCFIRPSGYCGRECGIKKGSSGYCAWPACYCYGLPNWVKVWDRATNKC

SEQ ID NO: 1365 - protein, 64 aa, Tityus zulianus; identical to SEQ ID NO: 704

SEQ ID NO: 1366 - protein, 681 aa, Bacillus thuringiensis
MGGIDMNPYQNKNEYEIFNAPSNGFSKSNNYSRYPLANKPNQPLKNTNYKDWLNVCQDNQQYGNNAGNFASSETIVGVSAGIIVVGTMLGAFAAPVLAAGIISFGTLLPIFWQGSDPANVWQDLLNIGGRPIQEIDKNIINVLTSIVTPIKNQLDKYQEFFDKWEPARTHANAKAVHDLFTTLEPIIDKDLDMLKNNASYRIPTLPAYAQIATWHLNLLKHAATYYNIWLQNQGINPSTFNSSNYYQGYLKRKIQEYTDYCIQTYNAGLTMIRTNTNATWNMYNTYRLEMTLTVLDLIAIFPNYDPEKYPIGVKSELIREVYTNVNSDTFRTITELENGLTRNPTLFTWINQGRFYTRNSRDILDPYDIFSFTGNQMAFTHTNDDRNIIWRAVHGNIISQDTSKVFPFYRNKPIDKVEIVRHREYSDIIYEMIFFSNSSEVFRYSSNSTIENNYKRTDSYMIPKQTWKNEEYGHTLSYIKTDNYIFSVVRERRRVAFSWTHTSVDFQNTIDLDNITQIHALKTLKVSSNSKIVKGLGHTSENLVILKDSMNFRVRFLKNVSQQYQVRIRYATNAPKTTVFLTGIDTISVELPSTTSRQNPNATDLTYADFGYVTFSRTVSNKTFEGEDTFINDLYYGTPNHSYNIYIDKIEFIPITQSVLDYTEKQNIEKTQKIVNDLFVN

SEQ ID NO: 1367 - protein, 681 aa, Bacillus thuringiensis; identical to SEQ ID NO: 1366

SEQ ID NO: 1368 - protein, 1176 aa, Bacillus thuringiensis
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFSNYDSRRYPIRTVSQLTREIYTNPVLENFDGSFRGMAQRIEQNIRQPHLMDILNSITIYTDVHRGFNYWSGHQITASPVGFSGPEFAFPLFGNAGNAAPPVLVSLTGLGIFRTLSSPLYRRIILGSGPNNQELFVLDGTEFSFASLTTNLPSTIYRQRGTVDSLDVIPPQDNSVPPRAGFSHRLSHVTMLSQAAGAVYTLRAPTFSWQHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKQELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEGQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVQLLLMEE

SEQ ID NO: 1369 - protein, 1176 aa, Bacillus thuringiensis; identical to SEQ ID NO: 1368

SEQ ID NO: 1370 - protein, 1176 aa, Bacillus thuringiensis
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFSNYDSRRYPIRTVSQLTREIYTNPVLENFDGSFRGMAQRIEQNIRQPHLMDILNSITIYTDVHRGFNYWSGHQITASPVGFSGPEFAFPLFGNAGNAAPPVLVSLTGLGIFRTLSSPLYRRIILGSGPNNQELFVLDGTEFSFASLTTNLPSTIYRQRGTVDSLDVIPPQDNSVPPRAGFSHRLSHVTMLSQAAGAVYTLRAPTFSWQHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKQELSEKVKHAKRLSEERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVLPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 1371 - protein, 3826 aa, Bacillus thuringiensis
CCTGGGTCAAAAATTGATATTTAGTAAAATTAGTTGCACTTTGTGCATTTTTTCATAAGATGAGTCATATGTTTTAAATTGTAGTAATGAAAAACAGTATTATATCATAATGAATTGGTATCTTAATAAAAGAGATGGAGGTAACTTATGGATAACAATCCGAACATCAATGAATGCATTCCTTATAATTGTTTAAGTAACCCTGAAGTAGAAGTATTAGGTGGAGAAAGAATAGAAACTGGTTACACCCCAATCGATATTTCCTTGTCGCTAACGCAATTTCTTTTGAGTGAATTTGTTCCCGGTGCTGGATTTGTGTTAGGACTAGTTGATATAATATGGGGAATTTTTGGTCCCTCTCAATGGGACGCATTTCTTGTACAAATTGAACAGTTAATTAACCAAAGAATAGAAGAATTCGCTAGGAACCAAGCCATTTCTAGATTAGAAGGACTAAGCAATCTTTATCAAATTTACGCAGAATCTTTTAGAGAGTGGGAAGCAGATCCTACTAATCCAGCATTAAGAGAAGAGATGCGTATTCAATTCAATGACATGAACAGTGCCCTTACAACCGCTATTCCTCTTTTGGCAGTTCAAAATTATCAAGTTCCTCTTTTATCAGTATATGTTCAAGCTGCAAATTTACATTTATCAGTTTTGAGAGATGTTTCAGTGTTTGGACAAAGGTGGGGATTTGATGCCGCGACTATCAATAGTCGTTATAATGATTTAACTAGGCTTATTGGCAACTATACAGATTATGCTGTGCGCTGGTACAATACGGGATTAGAGCGTGTATGGGGACCGGATTCTAGAGATTGGGTAAGGTATAATCAATTTAGAAGAGAGCTAACACTTACTGTATTAGATATCGTTGCTCTATTCTCAAATTATGATAGTCGAAGGTATCCAATTCGAACAGTTTCCCAATTAACAAGAGAAATTTATACGAACCCAGTATTAGAAAATTTTGATGGTAGTTTTCGTGGAATGGCTCAGAGAATAGAACAGAATATTAGGCAACCACATCTTATGGATATCCTTAATAGTATAACCATTTATACTGATGTGCATAGAGGCTTTAATTATTGGTCAGGGCATCAAATAACAGCTTCTCCTGTAGGGTTTTCAGGACCAGAATTCGCATTCCCTTTATTTGGGAATGCGGGGAATGCAGCTCCACCCGTACTTGTCTCATTAACTGGTTTGGGGATTTTTAGAACATTATCTTCACCTTTATATAGAAGAATTATACTTGGTTCAGGCCCAAATAATCAGGAACTGTTTGTCCTTGATGGAACGGAGTTTTCTTTTGCCTCCCTAACGACCAACTTGCCTTCCACTATATATAGACAAAGGGGTACAGTCGATTCACTAGATGTAATACCGCCACAGGATAATAGTGTACCACCTCGTGCGGGATTTAGCCATCGATTGAGTCATGTTACAATGCTGAGCCAAGCAGCTGGAGCAGTTTACACCTTGAGAGCTCCAACGTTTTCTTGGCAGCATCGCAGTGCTGAATTTAATAATATAATTCCTTCATCACAAATTACACAAATACCTTTAACAAAATCTACTAATCTTGGCTCTGGAACTTCTGTCGTTAAAGGACCAGGATTTACAGGAGGAGATATTCTTCGAAGAACTTCACCTGGCCAGATTTCAACCTTAAGAGTAAATATTACTGCACCATTATCACAAAGATATCGGGTAAGAATTCGCTACGCTTCTACTACAAATTTACAATTCCATACATCAATTGACGGAAGACCTATTAATCAGGGTAATTTTTCAGCAACTATGAGTAGTGGGAGTAATTTACAGTCCGGAAGCTTTAGGACTGTAGGTTTTACTACTCCGTTTAACTTTTCAAATGGATCAAGTGTATTTACGTTAAGTGCTCATGTCTTCAATTCAGGCAATGAAGTTTATATAGATCGAATTGAATTTGTTCCGGCAGAAGTAACCTTTGAGGCAGAATATGATTTAGAAAGAGCACAAAAGGCGGTGAATGAGCTGTTTACTTCTTCCAATCAAATCGGGTTAAAAACAGATGTGACGGATTATCATATTGATCAAGTATCCAATTTAGTTGAGTGTTTATCAGATGAATTTTGTCTGGATGAAAAACAAGAATTGTCCGAGAAAGTCAAACATGCGAAGCGACTTAGTGATGAGCGGAATTTACTTCAAGATCCAAACTTCAGAGGGATCAATAGACAACTAGACCGTGGCTGGAGAGGAAGTACGGATATTACCATCCAAGGAGGCGATGACGTATTCAAAGAGAATTACGTTACGCTATTGGGTACCTTTGATGAGTGCTATCCAACGTATTTATATCAAAAAATAGATGAGTCGAAATTAAAAGCCTATACCCGTTATCAATTAAGAGGGTATATCGAAGATAGTCAAGACTTAGAAATCTATTTAATTCGCTACAATGCAAAACATGAAACAGTAAATGTGCCAGGTACGGGTTCCTTATGGCCGCTTTCAGCCCAAAGTCCAATCGGAAAGTGTGGAGAGCCGAATCGATGCGCGCCACACCTTGAATGGAATCCTGACTTAGATTGTTCGTGTAGGGATGGAGAAAAGTGTGCCCATCATTCGCATCATTTCTCCTTAGACATTGATGTAGGATGTACAGACTTAAATGAGGACCTAGGTGTATGGGTGATCTTTAAGATTAAGACGCAAGATGGGCACGCAAGACTAGGGAATCTAGAGTTTCTCGAAGAGAAACCATTAGTAGGAGAAGCGCTAGCTCGTGTGAAAAGAGCGGAGAAAAAATGGAGAGACAAACGTGAAAAATTGGAATGGGAAACAAATATCGTTTATAAAGAGGCAAAAGAATCTGTAGATGCTTTATTTGTAAACTCTCAATATGATCAATTACAAGCGGATACGAATATTGCCATGATTCATGCGGCAGATAAACGTGTTCATAGCATTCGAGAAGCTTATCTGCCTGAGCTGTCTGTGATTCCGGGTGTCAATGCGGCTATTTTTGAAGAATTAGAAGGGCGTATTTTCACTGCATTCTCCCTATATGATGCGAGAAATGTCATTAAAAATGGTGATTTTAATAATGGCTTATCCTGCTGGAACGTGAAAGGGCATGTAGATGTAGAAGAACAAAACAACCAACGTTCGGTCCTTGTTGTTCCGGAATGGGAAGCAGAAGTGTCACAAGAAGTTCGTGTCTGTCCGGGTCGTGGCTATATCCTTCGTGTCACAGCGTACAAGGAGGGATATGGAGAAGGTTGCGTAACCATTCATGAGATCGAGAACAATACAGACGAACTGAAGTTTAGCAACTGCGTAGAAGAGGAAATCTATCCAAATAACACGGTAACGTGTAATGATTATACTGTAAATCAAGAAGAATACGGAGGTGCGTACACTTCTCGTAATCGAGGATATAACGAAGCTCCTTCCGTACCAGCTGATTATGCGTCAGTCTATGAAGAAAAATCGTATACAGATGGACGAAGAGAGAATCCTTGTGAATTTAACAGAGGGTATAGGGATTACACGCCACTACCAGTTGGTTATGTGACAAAAGAATTAGAATACTTCCCAGAAACCGATAAGGTATGGATTGAGATTGGAGAAACGGAAGGAACATTTATCGTGGACAGCGTGGAATTACTCCTTATGGAGGAATAGTCTCATGCAAACTCAGGTTTAAATATCGTTTTCAAATCAATTGTCCAAGAGCAGCATTACAAATAGATAAGTAATTTGTTGTAATGAAAAACGGACATCACCTCCATTGAAACGGAGTGATGTCCGTTTTACTATGTTATTTTCTAGT

SEQ ID NO: 1372 - protein, 1156 aa, Bacillus thuringiensis
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDHAVRWYNTGLERVWGPDSRDWIRYNQFRRELTLTVLDIVSLFPNYDSRTYPIRTVSQLTREIYTNPVLENFDGSFRGSAQGIEGSIRSPHLMDILNSITIYTDAHRGEYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWVIFKIKTQDGHERLGNLEFLEGRAPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 1373 - protein, 2815 aa, Bacillus thuringiensis
AAATTGTAGTAATGAAAAACAGTATTATATCATAATGAATTGGTATCTTAATAAAAGAGATGGAGGTAACTTATGGATAACAATCCGAACATCAATGAATGCATTCCTTATAATTGTTTAAGTAACCCTGAAGTAGAAGTATTAGGTGGAGAAAGAATAGAAACTGGTTACACCCCAATCGATATTTCCTTGTCGCTAACGCAATTTCTTTTGAGTGAATTTGTTCCCGGTGCTGGATTTGTGTTAGGACTAGTTGATATAATATGGGGAATTTTTGGTCCCTCTCAATGGGACGCATTTCTTGTACAAATTGAACAGTTAATTAACCAAAGAATAGAAGAATTCGCTAGGAACCAAGCCATTTCTAGATTAGAAGGACTAAGCAATCTTTATCAAATTTACGCAGAATCTTTTAGAGAGTGGGAAGCAGATCCTACTAATCCAGCATTAAGAGAAGAGATGCGTATTCAATTCAATGACATGAACAGTGCCCTTACAACCGCTATTCCTCTTTTTGCAGTTCAAAATTATCAAGTTCCTCTTTTATCAGTATATGTTCAAGCTGCAAATTTACATTTATCAGTTTTGAGAGATGTTTCAGTGTTTGGACAAAGGTGGGGATTTGATGCCGCGACTATCAATAGTCGTTATAATGATTTAACTAGGCTTATTGGCAACTATACAGATCATGCTGTACGCTGGTACAATACGGGATTAGAGCGTGTATGGGGACCGGATTCTAGAGATTGGATAAGATATAATCAATTTAGAAGAGAATTAACACTAACTGTATTAGATATCGTTTCTCTATTTCCGAACTATGATAGTAGAACGTATCCAATTCGAACAGTTTCCCAATTAACAAGAGAAATTTATACAAACCCAGTATTAGAAAATTTTGATGGTAGTTTTCGAGGCTCGGCTCAGGGCATAGAAGGAAGTATTAGGAGTCCACATTTGATGGATATACTTAACAGTATAACCATCTATACGGATGCTCATAGAGGAGAATATTATTGGTCAGGGCATCAAATAATGGCTTCTCCTGTAGGGTTTTCGGGGCCAGAATTCACTTTTCCGCTATATGGAACTATGGGAAATGCAGCTCCACAACAACGTATTGTTGCTCAACTAGGTCAGGGCGTGTATAGAACATTATCGTCCACTTTATATAGAAGACCTTTTAATATAGGGATAAATAATCAACAACTATCTGTTCTTGACGGGACAGAATTTGCTTATGGAACCTCCTCAAATTTGCCATCCGCTGTATACAGAAAAAGCGGAACGGTAGATTCGCTGGATGAAATACCGCCACAGAATAACAACGTGCCACCTAGGCAAGGATTTAGTCATCGATTAAGCCATGTTTCAATGTTTCGTTCAGGCTTTAGTAATAGTAGTGTAAGTATAATAAGAGCTCCTATGTTCTCTTGGATACATCGTAGTGCTGAATTTAATAATATAATTCCTTCATCACAAATTACACAAATACCTTTAACAAAATCTACTAATCTTGGCTCTGGAACTTCTGTCGTTAAAGGACCAGGATTTACAGGAGGAGATATTCTTCGAAGAACTTCACCTGGCCAGATTTCAACCTTAAGAGTAAATATTACTGCACCATTATCACAAAGATATCGGGTAAGAATTCGCTACGCTTCTACCACAAATTTACAATTCCATACATCAATTGACGGAAGACCTATTAATCAGGGGAATTTTTCAGCAACTATGAGTAGTGGGAGTAATTTACAGTCCGGAAGCTTTAGGACTGTAGGTTTTACTACTCCGTTTAACTTTTCAAATGGATCAAGTGTATTTACGTTAAGTGCTCATGTCTTCAATTCAGGCAATGAAGTTTATATAGATCGAATTGAATTTGTTCCGGCAGAAGTAACCTTTGAGGCAGAATATGATTTAGAAAGAGCACAAAAGGCGGTGAATGAGCTGTTTACTTCTTCCAATCAAATCGGGTTAAAAACAGATGTGACGGATTATCATATTGATCAAGTATCCAATTTAGTTGAGTGTTTATCTGATGAATTTTGTCTGGATGAAAAAAAAGAATTGTCCGAGAAAGTCAAACATGCGAACGACTTAGTGATGAGCGGAATTTACTTCAAGATCCAAACTTTAGAGGGATCAATAGACAACTAGACCGTGGCTGGAGAGGAAGTACGGATATTACCATCCAAGGAGGCGATGACGTATTCAAAGAGAATTACGTTACGCTATTGGGTACCTTTGATGAGTGCTATCCAACGTATTTATATCAAAAAATAGATGAGTCGAAATTAAAAGCCTATACCCGTTACCAATTAAGAGGGTATATCGAAGATAGTCAAGACTTAGAAATCTATTTAATTCGCTACAATGCCAAACACGAAACAGTAAATGTGCCAGGTACGGGTTCCTTATGGCCGCTTTCAGCCCCAAGTCCAATCGGAAAATGTGCCCATCATTCCCATCATTTCTCCTTGGACATTGATGTTGGATGTACAGACTTAAATGAGGACTTAGGTGTATGGGTGATATTCAAGATTAAGACGCAAGATGGCCATGCAAGACTAGGAAATCTAGAATTTCTCGAAGAGAAACCATTAGTAGGAGAAGCACTAGCTCGTGTGAAAAGAGCGGAGAAAAAATGGAGAGACAAACGTGAAAAATTGGAATGGGAAACAAATATTGTTTATAAAGAGGCAAAAGAATCTGTAGATGCTTTATTTGTAAACTCTCAATATGATAGATTACAAGCGGATACCAACATCGCGATGATTCATGCGGCAGATAAACGCGTTCATAGCATTCGAGA

SEQ ID NO: 1374 - protein, 1181 aa, Bacillus thuringiensis
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDHAVRWYNTGLERVWGPDSRDWIRYNQFRRELTLTVLDIVSLFPNYDSRTYPIRTVSQLTREIYTNPVLENFDGSFRGSAQGIEGSIRSPHLMDILNSITIYTDAHRGEYYWSGHQIMASPVGFSGPEFTFPLYGTMGNAAPQQRIVAQLGQGVYRTLSSTLYRRPFNIGINNQQLSVLDGTEFAYGTSSNLPSAVYKKSGTVDSLDEIPPQNNNVPPRQGFSHRLSHVSMFRSGFSNSSVSIIRAPMFSWIHRSAEFNNIIPSSQITQIPLTKSTNLGSGTSVVKGPGFTGGDILRRTSPGQISTLRVNITAPLSQRYRVGIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKQELSEKVKHAKRLSDERNLLQDPNFRGINRQLDRGWRGSTDITIQGGDDVFKENCVTLLGTFDECYPTYLYQKIDESKLKAYTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 1375 - protein, 859 aa, Bacillus thuringiensis
MDILNSITIYTDAHRGEYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 1376 - protein, 1155 aa, Bacillus thuringiensis; identical to SEQ ID NO: 69

SEQ ID NO: 1377 - protein, 1155 aa, Bacillus thuringiensis
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDHAVRWYNTGLERVWGPDSRDWIRYNQFRRELTLTVLDIVSLFPNYDSRTYPIRTVSQLTREIYTNPVLENFDGSFRGSAQGIEGSIRSPHLMDILNSITIYTDAHRGEYYWSGHRIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNSSNGSSVFTLSAHVFNSGNEVYIDRIEFVPAEVTFEAEYDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKRETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYGRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 1378 - protein, 1181 aa, Bacillus thuringiensis
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDHAVRWYNTGLERVWGPDSRDWIRYNQFRRELTLTVLDIVSLFPNYDSRTYPIRTVSQLTREIYTNPVLENFDGSFRGSAQGIEGSIRSPHLMDILNSITIYTDAHRGEYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGLSNSSVSIIRAPMFSWIHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSRYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENSTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVDLLLMEE

SEQ ID NO: 1379 - protein, 1155 aa, Bacillus thuringiensis
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDHAVRWYNTGLERVWGPDSRDWIRYNQFRRELTLTVLDIVSLFPNYDSRTYPIRTVSQLTREIYTNPVLENFDGSFRGSAQGIEGSIRSPHLMDILNSITIYTDAHRGEYYWSGHQIMASPVGFSGPEFTFPLYGNMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 1380 - protein, 793 aa, Bacillus thuringiensis
MQCVPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFRAWEADPTNPALRVEMRIQFNDMNSALTTAIPLFAVQNYQVPLLSVYVQAANLHLSVLRDVSVFGQRWGFDATTINSRYNDLTRLIGNYTDYAVRWYNTGLERVWGPDSRDWIRYNQFRRELTLTVLDIVSLFPNYDSRTYPIRTVSQLTREIYTNPVLEDFNGSFRGSAQGIEQSIRSPHLMDILNSITIYTDAHRGYYYWSGHQIMASPVGFSGPEFTFPLYGTMGNAAPQQRIVAQLGQGVYRTLSSTFYRSPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTAGFTTPFNFSNGSSVFTLSAHVFNSGNEVYIDRIEFVPAEVTFEAEYDLERAQKAVNALFTSSNQIGLKTDVTDYHIDQVSNLVECLSDEFCLDEKQELSEKVKHAKRLSDERNLLQDPNFRWINRQLDRGWRGSTDITIQGGDDVFKENYVTLPGTFDECYPTYLYQKIDESKLKAYTRYQLRGYIEDSQDLEIYLIRYNAKHETVNVPGTGSLWPLSAQSPIGRCGEPNR

SEQ ID NO: 1381 - protein, 373 aa, Bacillus thuringiensis; identical to SEQ ID NO: 93

SEQ ID NO: 1382 - protein, 2990 aa, Bacillus thuringiensis
TATGTTTTAAATTGTAGTAATGAAAAACAGTATTATATCATAATGAATTGGTATCTTAATAAAAGAGATGGAGGTAACTTATGGATAACAATCCGAACATCAATGAATGCATTCCTTATAATTGTTTAAGTAACCCTGAAGTAGAAGTATTAGGTGGAGAAAGAATAGAAACTGGTTACACCCCAATCGATATTTCCTTGTCGCTAACGCAATTTCTTTTGAGTGAATTTGTTCCCGGTGCTGGATTTGTGTTAGGACTAGTTGATATAATATGGGGAATTTTTGGTCCCTCTCAATGGGACGCATTTCTTGTACAAATTGAACAGTTAATTAACCAAAGAATAGAAGAATTCGCTAGGAACCAAGCCATTTCTAGATTAGAAGGACTAAGCAATCTTTATCAAATTTACGCAGAATCTTTTAGAGAGTGGGAAGCAGATCCTACTAATCCAGCATTAAGAGAAGAGATGCGTATTCAATTCAATGACATGAACAGTGCCCTTACAACCGCTATTCCTCTTTTGGCAGTTCAAAATTATCAAGTTCCTCTTTTATCAGTATATGTTCAAGCTGCAAATTTACATTTATCAGTTTTGAGAGATGTTTCAGTGTTTGGACAAAGGTGGGGATTTGATGCCGCGACTATCAATAGTCGTTATAATGATTTAACTAGGCTTATTGGCAACTATACAGATTATGCTGTACGCTGGTACAATACGGGATTAGAACGTGTATGGGGACCGGATTCTAGAGATTGGGTAAGGTATAATCAATTTAGAAGAGAATTAACACTAACTGTATTAGATATCGTTGCTCTGTTCCCGAATTATGATAGTAGAAGATATCCAATTCGAACAGTTTCCCAATTAACAAGAGAAATTTATACAAACCCAGTATTAGAAAATTTTGATGGTAGTTTTCGAGGCTCGGCTCAGGGCATAGAAAGAAGTATTAGGAGTCCACATTTGATGGATATACTTAACAGTATAACCATCTATACGGATGCTCATAGGGGTTATTATTATTGGTCAGGGCATCAAATAATGGCTTCTCCTGTCGGGTTTTCGGGGCCAGAATTCACGTTTCCGCTATATGGAACCATGGGAAATGCAGCTCCACAACAACGTATTGTTGCTCAACTAGGTCAGGGCGTGTATAGAACATTATCCTCTACTTTTTATAGAAGACCTTTTAATATAGGGATAAATAATCAACAACTATCTGTTCTTGACGGGACAGAATTTGCTTATGGAACCTCCTCAAATTTGCCATCCGCTGTATACAGAAAAAGCGGAACGGTAGATTCGCTGGATGAAATACCACCACAGAATAACAACGTGCCACCTAGGCAAGGATTTAGTCATCGATTAAGCCATGTTTCAATGTTTCGTTCAGGCTCTAGTAGTAGTGTAAGTATAATAAGAGCTCCTATGTTCTCTTGGATACATCGTAGTGCTGAATTTAATAATATAATTGCATCGGATAGTATTACTCAAATCCCTGCAGTGAAGGGAAACTTTCTTTTTAATGGTTCTGTAATTTCAGGACCAGGATTTACTGGTGGGGACTTAGTTAGATTAAATAGTAGTGGAAATAACATTCAGAATAGAGGGTATATTGAAGTTCCAATTCACTTCCCATCGACATCTACCAGATATCGAGTTCGTGTACGGTATGCTTCTGTAACCCCGATTCACCTCAACGTTAATTGGGGTAATTCATCCATTTTTTCCAATACAGTACCAGCTACAGCTACGTCATTAGATAATCTACAATCAAGTGATTTTGGTTATTTTGAAAGTGCCAATGCTTTTACATCTTCATTAGGTAATATAGTAGGTGTTAGAAATTTTAGTGGGACTGCAGGAGTGATAATAGACAGATTTGAATTTATTCCAGTTACTGCAACACTCGAGGCTGAATATAATCTGGAAAGAGCGCAGAAGGCGGTGAATGCGCTGTTTACGTCTACAAACCAACTAGGGCTAAAAACAAATGTAACGGATTATCATATTGATCAAGTGTCCAATTTAGTTACGTATTTATCGGATGAATTTTGTCTGGATGAAAAGCGAGAATTGTCCGAGAAAGTCAAACATGCGAAGCGACTCAGTGATGAACGCAATTTACTCCAAGATTCAAATTTCAAAGACATTAATAGGCAACCAGAACGTGGGTGGGGCGGAAGTACAGGGATTACCATCCAAGGAGGGGATGACGTATTTAAAGAAAATTACGTCACACTATCAGGTACCTTTGATGAGTGCTATCCAACATATTTGTATCAAAAAATCGATGAATCAAAATTAAAAGCCTTTACCCGTTATCAATTAAGAGGGTATATCGAAGATAGTCAAGACTTAGAAATCTATTTAATTCGCTACAATGCAAAACATGAAACAGTAAATGTGCCAGGTACGGGTTCCTTATGGCCGCTTTCAGCCCAAAGTCCAATCGGAAAGTGTGGAGAGCCGAATCGATGCGCGCCACACCTTGAATGGAATCCTGACTTAGATTGTTCGTGTAGGGATGGAGAAAAGTGTGCCCATCATTCGCATCATTTCTCCTTAGACATTGATGTAGGATGTACAGACTTAAATGAGGACCTAGGTGTATGGGTGATCTTTAAGATTAAGACGCAAGATGGGCACGCAAGACTAGGGAATCTAGAGTTTCTCGAAGAGAAACCATTAGTAGGAGAAGCGCTAGCTCGTGTGAAAAGAGCGGAGAAAAAATGGAGAGACAAACGTGAAAAATTGGAATGGGAAACAAATATCGTTTATAAAGAGGCAAAAGAATCTGTAGATGCTTTATTTGTAAACTCTCAATATGATCAATTACAAGCGGATACGAATATTGCCATGATTCATGCGGCAGATAAACGTGTTCATAGCATTCGAGAAGCTTGGCGTAATCATGGTCATAGCTGTTTCCTGTGTGAAATTGTTATCCGCTCACAATTCCACACAACATACGAGCCGGAAGCATAA

SEQ ID NO: 1383 - protein, 1177 aa, Bacillus thuringiensis
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDHAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTFYRRSFNIGINNQQLSVLDGTEFAYGTSSNLPSAVYRKSGTVDSLDEIPPQNNNVPPRQGFSHRLSHVSMFRSGSSSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLYVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTCLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVSGTGSLWPLSAQSPIGKCGEPNRFAPHLEWNPDLDCSCRDGEKCAHHSHHFSLDIDVGCTDLNEDLGVWVIFKIKTQDGHARLGNLEFLGEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVPQEVRVCPGRGYILRVTAYKEGYGEGCVTIHEIENNTDELKFSNCVEEEVYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVQLLLMEE

SEQ ID NO: 1384 - protein, 609 aa, Bacillus thuringiensis
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDHAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTFYRRPFNIGINNQQLSVLDGTEFAYGTSSNLPSAIYRKSGTVDSLDEIPPQNNNVPPRQGFSHRLSHVSMFRSGSSSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLYVNWGNSSIFSNTVPATATSLDNLQSSDFGYFESANAFTSSLGNIVGVRNFSGTAGVIIDRFEFIPVTA

SEQ ID NO: 1385 - protein, 609 aa, Bacillus thuringiensis
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDHAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTFYRRPFNIGINNQQLSVLDGTEFAYGTSSNLPSAVYRKSGTVDSLDEIPPQNNNVPPRQGFSHRLSHVSMFRSGSSSSVSIIRAPMFSWIHRSAEFNNIIASDSITQIPAVKGNVLFNGSVISGPGFTGGDLVRLNSSGNNIQNRGYIEVPIHFPSTSTRYRVRVRYASVTPIHLYVNWGNSSIFSNTVPATATSLDNLQSSDFGYFESANAFTSSLGNIVGVRNFSGTAGVIIDRFEFIPVTA

SEQ ID NO: 1386 - protein, 4106 aa, Bacillus thuringiensis
TAGATTTTATATAAGTATAAAAAATAATAAGACTTTAATATAAGTTAAGGGAATACAAATCCTTAATGCATTGGTTAAATATTATAAACTCTAAAGCATGGATGATGGTTGAGAAGTAAGTAGATTATTAACACCCTGGGTCTATTTTAGCCCCAGGGTATAAATTGATATTTAATAAAATCGGTTGCACTTTGAGTATTTTTTCATAGAATGACTCATATGATTAACATTGCAATACAGTAAAAGATCTTTAGTTATAAAGAAAAACTATTACGCTAAAAAGTGGAGGGAACATATGGAGAATAATATTCAAAATCAATGCGTACCTTACAATTGTTTAAGTAATCCTGAGGAGATACTTTTAGATGGAGAAAGAATATCAACTGGTAATTCATCAATTGATATCTCTCTGTCACTTGTCCAGCTTCTGGTATCTAACTTTGTACCAGGGGGAGGATTTTTAGTTGGATTATTAGATTTTGTATGGGGAATAGTAGGCCCTTCTCCATGGGATGCATTTCTAGTGCAAATTGAACAATTAATTAATGAAAGAATAGCTGCATATGCTAGGTCTGCAGCAATTTCTAATTTAGAAGGATTAGGAAACAATTTCAATATATATGTGGAAGCATTTAAAGAATGGGAAGCAGATCCTGATAATCCAGTAACCAGGACTAGAGTAGTTGATCGCTTTCGTATACTTGATGGGCTACTTGAAAGGGACATCCCTTCATTTCGAATTGCTGGATTTGAAGTACCCCTTTTATCCGTTTATGCTCAAGCGGCCAATTTGCATCTAGCTATATTAAGAGATTCTTCAATTTTTGGAGCAAGATGGGGATTGACAACAATAAATGTCAATGAAAACTATAATAGGCTAATTAGGCATATTGATGAATATGCTAATCACTGTGCAGATACGTATAATCGGGGATTAAATAATTTACCAAAATCTACGTATCAAGATTGGATAACATATAATCGATTACGGAGAGACTTAACATTAACTGTATTAGATATCGCTGCTTTCTTTCCAAGCTATGACAATAGGAGATATCCAATTCAGTCAGTTGGTCAACTAACAAGGGAAATTTATACGGACCCATTAATTACTTTTAATCCACAGTTACAGTCTGTAGCTCAATTACCTACTTTTAACGTTATGGAAAGCAACGCAATTAGAACTCCTCATTTATTTGATGTATTGAATAATCTTACAATTTTTACAGATTGGTTTAGTGTTGGACGCAACTTTTATTGGGGAGGACATCGAGTAATATCTAACCGTATAGGAGGAGGTAACATAACATCTCCTATATATGGAAGAGAGGCGAATCAGGAGCCTCCAAGATCTTTTACTTTTAATGGGCCTGTTTTTAGGACTTTATCAAATCCTACTTTTAGACCTTTACAGCAACCTTGGCCAGCGCCACCATTTAATTTACGTGGTGTTGAAGGAGTAGAATTTTCTACACCTTTAAATAGCTTTACGTATCGAGGAAGAGGTACGGTTGATTCTTTAACTGAGTTACCGCCTGAGGATAATAGTGTGCCTCCTCGCGAAGGATATAGTCATCGTTTATGTCATGCAACTTTTGTTCAAAGATCTGGAACCCCATTTTTAACAACTGGTCCAGTATTTTCTTGGACGCATCGTAGTGCTACTGATCGAAATATAATCTACCCGGATGTAATTAACCAAATACCGTTAGTAAAAGCATTCAACCTTACTTCAGGTACCTCTGTAGTCAGAGGTCCAGGATTTACAGGAGGGGATATCATCCGAACTAACGTTAATGGTAGTGTACTAAGTATGAGTCTTAATTTTAGTAACACAACATTACAGCGGTATCGTGTGAGAGTTCGTTATGCTGCTTCTCAAACAATGGTCATGAGCGTAACTGTTGGAGGGAGTACTACTGGTAATCAAGGATTCCCTAGTACTATGAGTGCAAATGGGGCTTTGACATCTCAATCATTTAGATTCGCAGAATTTCCTGTAGGTATTAGTGCATCTGGCAGTCAAGGTGCATCAATAAGTATTAGTAATAATGTAGGTAGACAAATGTTTCACTTAGATAGAATTGAATTTCTCCCAGTTACTTCTACATTTGAGGAGGAATATGATTTAGAAAGAGCGCAAGAGGCGGTGAATGCCCTGTTTACTTCTACGAACCAACTAGGGCTAAAAACAGATGTAACGGATTATCATATTGATCAAGTATCAAATCTAGTTGAATGCTTATCGGATGAATTTTGTCTGGATGAAAAGCGAGAATTGTCTGAGAAAGTCAAACATGCGAAGCGACTCAGCGATGAGCGCAATTTACTCCAGGATCGAAATTTCAGATCCATTAATGGGCAACTAGACCGTGGCTGGAGAGGAAGTACGGATATTACCATCCAAGGTGGAGATGACGTATTCAAAGAGAATTACGTCACACTGCCGGGTACCTTTGATGAGTGCTATCCAACGTATCTATATCAAAAAATAGATGAATCGAAATTAAAATCCTATACACGTTACGAGTTAAGAGGGTATATCGAGGATAGTCAAGATTTAGAAATCTATTTGATTCGCTACAATGCAAAACACGAAATAGTAAATGTACCAGGTACAGGGAGTTTATGGCCTCTTTCTATAGAAAATTCAATTGGGCCTTGTGGAGAACCGAATCGCTGCGCGCCACACCTTGAATGGAATCCTAATCTAGATTGTTCCTGCAGGGACGGGGAAAAATGTGCCCATCATTCCCATCATTTCTCCTTGGACATTGATGTTGGATGTACAGACTTAAATGAGGACTTAGGTGTATGGGTGATCTTCAAGATTAAGACGCAAGATGGCCATGCAAGACTAGGAAATCTAGAGTTTCTCGAAGAGAAACCACTATTAGGGGAAGCACTAGCTCGTGTGAAAAGAGCGGAGAAGAAATGGAGAGACAAACGTGAAAAATTGGAATGGGAAACAAATATTGTTTATAAAGAGGCAAAAGAATCTGTAGATGCTTTATTTGTGAACTCTCAATATGATAGATTACAAGCGGATACGAATATCGCGATGATTCATGCGGCAGATAAACGCGTTCATAGAATTAGAGAAGCATACCTTCCAGAATTATCTGTAATTCCGGGTGTAAATGCGGGCATTTTCGAAGAATTAGAGGGACGCATTTTCACAGCCTACTCTCTATATGATGCGAGAAATGTCATTAAAAATGGCGATTTCAATAATGGTTTATTATGCTGGAACTTGAAAGGGCATGTAGATGTAGAAGAACAAAACAACCATCGTTCAGTCCTTGTTGTCCCGGAATGGGAAGCAGAGGTGTCCCAAGAAGTTCGTGTCTGTCCAGGTCGTGGCTATATCCTTCGTGTTACAGCGTACAAAGAGGGATATGGAGAGGGCTGCGTAACCATTCATGAGATCGAAGACAATACAGACGAACTGAAATTTAGCAACTGTGTTGAAGAGGAAGTATATCCAAACAACACGGTAACGTGTAATGATTATACTGCGACTCAAGAAGAATACGGGGGTGCGTACACTTCCCGTAATCATGGATATGGCAAATCTTATGAAAGTAATTCTTCCGTACAAGCTGATTATGCGTCAGTTTATGAAGAAAAAGCGGACACAGATGGACGAAGAGATAATCATTGCGAATCTAACAGAGGGTATGGGGATTACACGCCACTACCAGCTGGTTATGTAACAAAAGAATTAGAATACTTCCCAGAAACCGATAAGGTATGGGTTGAGATTGGAGAAACGGAAGGAACATTCATTGTGGATAGTGTGGAATTACTCCTTATGGAGGAATAAGGTATGTTTTAAAATGTAGCGTGTGCAAATAAAGAATGTTTACTGACCAGTATTAACAGATAAATAAGAAACTTCTATATAAATAAAAAACGGACATCAATCTTAAGAGAATGATGTCCGTTTTTTGTATGATTTGATTCAACGAGTGATATGTAAATATATTTTTTTGCGAAGTCTTTACATAACAAAAAAATTCGTATAGCAAAATTCTAAATTTAACCTTAAATATAGTTAGGGTGAAAATATGCCAAACTAATTTATTCCGAATGTTAATTCGAAA

SEQ ID NO: 1387 - protein, 1171 aa, Bacillus thuringiensis; identical to SEQ ID NO: 176

SEQ ID NO: 1388 - protein, 4231 aa, Bacillus thuringiensis
GTACCAAATTATAAGAACTTTGGTATTTCAATAAAAGAAAATGGAGGTATTTTATGGAGATAGTGAATAATCAGAATCAATGCGTGCCTTATAATTGTTTAAATAATCCTGAAAATGAGATATTAGATATTGAAAGGTCAAATAGTACTGTAGCAACAAACATCGCCTTGGAGATTAGTCGTCTGCTCGCTTCCGCAACTCCAATAGGGGGGATTTTATTAGGATTGTTTGATGCAATATGGGGGTCTATAGGCCCTTCACAATGGGATTTATTTTTAGAGCAAATTGAGCTATTGATTGACCAAAAAATAGAGGAATTCGCTAGAAACCAGGCAATTTCTAGATTAGAAGGGATAAGCAGTCTGTACGGAATTTATACAGAAGCTTTTAGAGAGTGGGAAGCAGATCCTACTAATCCAGCATTAAAAGAAGAGATGCGTACTCAATTTAATGACATGAACAGTATTCTTGTAACAGCTATTCCTCTTTTTTCAGTTCAAAATTATCAAGTCCCATTTTTATCAGTATATGTTCAAGCTGCAAATTTACATTTATCGGTTTTGAGAGATGTTTCAGTGTTTGGGCAGGCTTGGGGATTTGATATAGCAACAATAAATAGTCGTTATAATGATCTGACTAGACTTATTCCTATATATACAGATTATGCTGTACGCTGGTACAATACGGGATTAGATCGCTTACCACGAACTGGTGGGCTGCGAAACTGGGCAAGATTTAATCAGTTTAGAAGAGAGTTAACAATATCAGTATTAGATATTATTTCTTTTTTCAGAAATTACGATTCTAGATTATATCCAATTCCAACAAGCTCCCAATTAACGCGGGAAGTATATACAGATCCGGTAATTAATATAACTGACTATAGAGTTGGCCCCAGCTTCGAGAATATTGAGAACTCAGCCATTAGAAGCCCCCACCTTATGGACTTCTTAAATAATTTGACCATTGATACGGATTTGATTAGAGGTGTTCACTATTGGGCAGGGCATCGTGTAACTTCTCATTTTACAGGTAGTTCTCAAGTGATAACAACCCCTCAATATGGGATAACCGCAAATGCGGAACCAAGACGAACTATTGCTCCTAGTACTTTTCCAGGTCTTAACCTATTTTATAGAACATTATCAAATCCTTTCTTCCGAAGATCAGAAAATATTACTCCTACCTTAGGGATAAATGTAGTACAGGGAGTAGGGTTCATTCAACCAAATAATGCTGAAGTTCTATATAGAAGTAGGGGGACAGTAGATTCTCTTAATGAGTTACCAATTGATGGTGAGAATTCATTAGTTGGATATAGTCATCGATTAAGTCATGTTACACTAACCAGGTCGTTATATAATACTAATATAACTAGCCTGCCAACATTTGTTTGGACACATCACAGTGCTACTAATACAAATACAATTAATCCAGATATTATTACACAAATACCTTTAGTGAAAGGATTTAGACTTGGTGGTGGCACCTCTGTCATTAAAGGACCAGGATTTACAGGAGGGGATATCCTTCGAAGAAATACCATTGGTGAGTTTGTGTCTTTACAAGTCAATATTAACTCACCAATTACCCAAAGATACCGTTTAAGATTTCGTTATGCTTCCAGTAGGGATGCACGAATTACTGTAGCGATAGGAGGACAAATTAGAGTAGATATGACCCTTGAAAAAACCATGGAAATTGGGGAGAGCTTAACATCTAGAACATTTAGCTATACCAATTTTAGTAATCCTTTTTCATTTAGGGCTAATCCAGATATAATTAGAATAGCTGAAGAACTTCCTATTCGTGGTGGTGAGCTTTATATAGATAAAATTGAACTTATTCTAGCAGATGCAACATTTGAAGAAGAATATGATTTGGAAAGAGCACAGAAGGCGGTGAATGCCCTGTTTACTTCTACAAATCAACTAGGGCTAAAAACAGATGTGACGGATTATCATATTGATCAAGTTTCCAATTTAGTTGAGTGTTTATCGGATGAATTTTGTCTGGATGAAAAGAGAGAATTATCCGAGAAAGTCAAACATGCGAAGCGACTCAGTGATGAACGGAATTTACTTCAAGATTCAAACTTCAGAGGGATCAATAGGCAACCAGACCGTGGCTGGAGAGGAAGCACGGATATTACTATCCAAGGTGGAGATGACGTATTCAAAGAGAATTACGTCACATTACCGGGTACCTTTGATGAGTGCTATCCAACGTATTTATATCAAAAAATAGATGAGTCGAAGTTAAAAGCTTATACCCGCTATGAATTAAGAGGGTATATCGAGGATAGTCAAGACTTAGAAATCTATTTAATTCGCTACAATGCAAAACACGAGACAGTAAACGTGCCAGGTACGGGTTCCTTATGGCCGCTTTCAGCCCAAAGTCCAATCGGAAAGTGTGGAGAACCGAATCGATGCGCGCCACACCTTGAATGGAATCCTAATCTAGATTGCTCCTGCAGAGACGGGGAAAAATGTGCCCATCATTCCCATCATTTCTCCTTGGACATTGATGTTGGATGTACAGACTTAAATGAGGACTTAGGTGTATGGGTGATATTCAAGATTAAGACACAAGATGGCTATGCAAGACTAGGAAATCTAGAGTTTCTCGAAGAGAAACCACTATTAGGGGAAGCACTAGCTCGTGTGAAAAGAGCGGAGAAAAAATGGAGAGACAAATGCGAAAAATTGGAATGGGAAACAAATATTGTTTATAAAGAGGCAAAAGAATCTGTAGATGCTTTATTTGTAAACTCTCAATATGATAGATTACAAGCGGATACGAATATCGCGATGATTCATGCGGCAGATAAACGCGTTCATAGCATTCGAGAAGCGTATCTGCCAGAGCTGTCTGTGATTCCGGGTGTCAATGCGGCTATTTTTGAAGAATTAGAAGGGCGTATTTTCACTGCATTCTCCCTATATGATGCGAGAAATGTCATTAAAAATGGCGATTTCAATAATGGCTTATCATGCTGGAACGTGAAAGGGCATGTAGATGTAGAAGAACAGAACAACCATCGTTCGGTCCTTGTTGTTCCAGAATGGGAAGCAGAAGTGTCACAAGAAGTTCGTGTTTGTCCGGGTCGTGGCTATATCCTTCGTGTTACAGCGTACAAAGAGGGATATGGAGAGGGCTGTGTAACGATTCATGAGATCGAAGACAATACAGACGAACTGAAATTCAGCAACTGTGTAGAAGAGGAAGTATATCCAAACAACACGGTAACGTGTAATAATTATACTGCGACTCAAGAAGAACATGAGGGTACGTACACTTCCCGTAATCGAGGATATGACGAAGCCTATGAAAGCAATTCTTCTGTACATGCGTCAGTCTATGAAGAAAAATCGTATACAGATAGACGAAGAGAGAATCCTTGTGAATCTAACAGAGGATATGGGGATTACACACCACTACCAGCTGGCTATGTGACAAAAGAATTAGAGTACTTCCCAGAAACCGATAAGGTATGGATTGAGATCGGAGAAACGGAAGGAACATTCATCGTGGACAGCGTGGAATTACTTCTTATGGAGGAATAATATATGCTTTAAAATGTAAGGTGTGCAAATAAAGAATGATTACTGACTTGTATTGACAGATAAATAAGGAAATTTTTATATGAATAAAAAACGGGCATCACTCTTAAAAGAATGATGTCCGTTTTTTGTATGATTTAACGAGTGATATTTAAATGTTTTTTTGCGAAGGCTTTACTTAACAAAAAAATTCGTATAGCAAAATTCTAAATTTAACCTTAAATATAGTTAGGGTGAAAATATGCCAAACTAATTTATTCCTAATGTTAATTCGAAACAAATCATAAACAAAAATACAGGTATAAAAAAATTTGTGTAAGACATTTTTTTATACCTGTACTATGAGTGTATTTCCCCTGTTAAAATATTTAATCAAAACTATCATCTTTTTATTATCTTTAGGAATATATGGAGAGTAAAATGAGATTTCATCTAAATAAAAAATAGTAACTACTCAGCCACCTTTTGGTGTCTTTTTTTAATTTTACTAGTTTCATATGCCTCCCATTTGTAAATACTGAGTATATCAAACAGGGGGTGAATAAGATGGTCGATCGAAAACTCATTTTAGATGCATATAAAAAAGGACCTGAAGCTGTTATTTCTTTATTTGAAGAAACATTCTCTAAGTTAGAAAAACGAATTCAAGAACTAGAACACGCTTC

SEQ ID NO: 1389 - protein, 1168 aa, Bacillus thuringiensis
MKNNIQNQCVPYNCLSNPEVEILSEERSTGRLPLDISLSLTRFLLSEFVPGVGVAFGLFDLIWGFITPSEWSLFLLQIEQLIEQRIETLERNRAITTLRGLADSYEVYLEALREWEENPNNAQLREDVRIRFANTDDALITAINNFTLTSFEIPLLSVYVQAANLHLSLLRDAVSFGQGWGLDIATVNNHYNRLINLIHRYTEHCLDTYNQGLENLRGTNTRQWSRFNQFRRELTLTVLDIVALFPNYDARAYPIQTSSQLTREIYTSSVIEDSPVSANIPNGFNRAEFGVRPPHLMDFMNSLFVTAETVRSQTVWGGHLVSSRNTAGNPINFPIYGVFNPGGAIWIADEDPRPFYRTLSDPVFVRGGFGDPHYVLGLRGVGFQQTGTNHTRTFRNSGTIDSLDEIPPQDNSGAPWNDYSHVLNHVTFVRWPGEIAGSDSWRAPMFSWTHRSADRTNIINPNIITQIPAVKAHNLHSGSTVVRGPGFTGGDLLRRTNTGTFADIRVNITGPLSQRYRVRIRYASTTDLQFFTRINGTSVNQGNFQRTMNRGDNLESGNFRTAGFSTPFSFSNAQSTFTLGTQAFSNQEVYIDRIEFVPAEVTFEAESDLERAQKAVNALFTSTSQLGLKTNVTGYHIDQVSNLVACLSDEFCLDEKRELSEKVKHAKRLSDKRNLLQDPNFRGINRQPDHGWRGSTDITIQGGDDVFKENYVTLPGTFDECYPTYLYQKIDESKLKAYTRYQLRGYIEDSQDLEIYLIRYNSKHEIVNVPGTGSLWPLSVENQIGPCGEPNRCAPHLEWNPDLHCSCRDGEKCVHHSHHFSLDIDVGCTDLNEDLGVWLIFKIKTQDGHARLGNLEFLEEEPLLGEALGRVKRAEKKWRDKREKLQLETNIVYKEAKESVDALFVNSQYDRLQADTNIAMIHAADKRVHRIREAYLPELSVIPGVNAAIFEELEGRIFTAYSLYDARNVIKNGNFNNGLLCWNVKGHVDVEEQNNHRSVLVVPEWEAEVSQEVRVCPGRGYILRVTAYKEGYGEGCVTIHEVDNNTDELKFSNCEKEQVYPGNTVACNDYNKNHGANACSSRNRGYDESYESNSSIPADYAPVYEEEAYTDGQRGNPCEFNRGHTPLPAGYVTAELEYFPETDTVWVEIGETEGTFIVDSVELLLMEE

SEQ ID NO: 1390 - protein, 719 aa, Bacillus thuringiensis
MKLKNPDKHQSFSSNAKVDKISTDSLKNETDIELQNINHEDCLKMSEYENVEPFVSASTIQTGIGIAGKILGTLGVPFAGQVASLYSFILGELWPKGKNQWEIFMEHVEEIINQKISTYARNKALTDLKGLGDALAVYHDSLESWVGNRNNTRARSVVKSQYIALELMFVQKLPSFAVSGEEVPLLPIYAQAANLHLLLLRDASIFGKEWGLSSSEISTFYNRQVERAGDYSDHCVKWYSTGLNNLRGTNAESWVRYNQFRRDMTLMVLDLVALFPSYDTQIYPIKTTAQLTREVYTDAIGTVHPHPSFTSTTWYNNNAPSFSAIEAAVVRNPHLLDFLEQVTIYSLLSRWSNTQYMNMWGGHKLEFRTIGGTLNISTQGSTNTSINPVTLPFTSRDVYRTESLAGLNLFSTQPDNGVPRVDFHWKFVTHPIASDNFYYPGYAGIGTQLQDSENELPPEATGQPSYESYSHRLSHIGLISASHVKALVYSWTHRSADRTNTIEPNSITQIPLVKAFNLSSGAAVVRGPGFTGGDILRRTNTGTFGDIRVNINPPFAQRYRVRIRYASTTDLQFHTSINGKAINQGNFSATMNRGEDLDYKTFRTVGFTTPFSFLDVQSTFTIGAWNFSSGNEVYIDRIEFVPVEVTYEAEYDFEKAQEKVTALFTSTNPRGLKTDVKDYHIDQVSNLVESLSDEFYLDEKRELFEIVKYAKQLHIERNM

SEQ ID NO: 1391 - protein, 722 aa, Bacillus thuringiensis
MKLKNQDKHQSFSSNAKVDKISTDSLKNETDIELQNINHEDCLKMSEYENVEPFVSASTIQTGIGIAGKILGTLGVPFAGQVASLYSFILGELWPKGKNQWEIFMEHVEEIINQKISTYARNKALTDLKGLGDALAVYHDSLESWVGNRNNTRARSVVKSQYIALELMFVQKLPSFAVSGEEVPLLPIYAQAANLHLLLLRDASIFGKEWGLSSSEISTFYNRQVERAGDYPDHCVKWYSTGLNNLRGTNAESWVRYNQFRRDMTLMVLDLVALLPSYDTQMYPIKTTAQLTREVYTDAIGTVHPHPSFTSTTWYNNNAPSFSAIEAAVVRNPHLLDFLEQVTIYSLLSRWSNTQYMNMWGGHKLEFRTIGGTLNISTQGSTNTSINPVTLPFTSRDVYRTESLAGLNLFLTQPVNGVPRVDFHWKFVTHPIASDNFYYPGYAGIGTQLQDSENELPPEATGQPNYESYSHRLSHIGLISASHVKALVYSWTHRSADRTNTIEPNSITQIPLVKAFNLSSGAAVVRGPGFTGGDILRRTNTGTFGDIRVNINPPFAQRYRVRIRYASTTDLQFHTSINGKAINQGNFSATMNRGEDLDYKTFRTVGFTTPFSFLDVQSTFTIGAWNFSSGNEVYIDRIEFVPVEVTYEAEYDFEKAQEKVTALFTSTNPRGLKTDVKDYHIDQVSNLVESLSDEFYLDEKRELFEIVKYAKQLHIERNMVDA

SEQ ID NO: 1392 - protein, 717 aa, Bacillus thuringiensis
MKLKNQDKHQSFSSNAKVDKISTDSLKNETDIELQNINHEDCLKMSEYENVEPFVSASTIQTGIGIAGKILGTLGVPFAGQVASLYSFILGEPWPKGKNQWEIFMEHVEEIINQKISTYARNKALTDLKGLGDALAVYHDSLESWVGNRNNTRARSVVKSQYIALELMFVQRLPSFAVSGEEVPLLPIYAQAANLHLLLLRDASIFGKEWRLSSSEISTFYNRQVERAGDYSDHCVKWYSTGLNNLRGTNAESWVRYNQFRRDMTLMVLDLVALFPSYDTQMYPIKTTAQLTREVYTDAIGTVHPHPSFTSTTWYNNNAPSFSAIEAAVVRSPHLLDFLEQVTIYSLLSRWSNTQYMNMWGGHKLEFRTIGGTLNISTQGSTNTSINPVTLPFTSRDVYRTESLAGLNLFLTQPVNGVPRVDFHWKFVTHPIASDNFYYPGYAGIGTQLQDSENELPPEATGQPNYESYSHRLSHIGLISASHVKALVYSWTHRSADRTNTIEPNSITQIPLVKAFNLSSGAAVVRGPGFTGGDILRRTNTGTFGYIRVNINPPFAQRYRVRIRYASTTDLQFHTSINGKAINQGNFSATMNRGEDLDYKTFRTVGFTTPFSFLDVQSTFTIGAWNFSSGNEVYIDRIEFVPVEVTYEAEYDSEKAQEKVTALFTSTNPRGLKTDVKDYHIDQVSNLVESLSDEFYLDEKRELFEIVKYAKQLHIER

SEQ ID NO: 1393 - protein, 722 aa, Bacillus thuringiensis
MKLKNQDKHQSFSSNAKVDKISTDSLKNETDIELQNINHEDCLKMSEYENVEPFVSASTIQTGIGIAGKILGTLGVPFAGQVASLYSFILGELWPKGKSQWEIFMEHVEEIINQKISTYARNKALTDLKGLGDALAVYHDSLESWVGNRNNTRARSVVKSQYIALELMFVQKLPSFAVSGEEVPLLPIYAQAANLHLLLLRDASIFGKEWGLSSSEISTFYNHQVERAGDYSDHCVKWYSTGLNNLRGTNAESWVRYNQFRRDMTLMVLDLVALFPSYDIQMYPIKTTAQLTREVYTDAIGTVHPHPSFTSTTWYNNNAPSFSAIEAAVVRNPHLLDFLEQVTIYSLLSRWSNTQYMNMWGGHKLEFRTIGGTLNISTQGSTNTSINPVTLPFTSRDVYRTESLAGLNLFLTQPVNGVPRVDFHWKFVTHPIASDNFYYPGYAGIGTQLQDSENELPPEATGQPNYESYSHRLSHIGLISASHVKALVYSWTHRSADRTNTIEPNSITQIPLVKAFNLSSGAAVVRGPGFTGGDILRRTNTGTFGDIRVNINPPFAQRYRVRIRYASTTDLQFHTSINGKAINQGNFSATMNRGEDLDYKTFRTVGFTTPFSFLDVQSTFTIGAWNFSSGNEVYIDRIEFVPVEVTYEAEYDFEKAQEKVTALFTSTNPRGLKTDVKDYHIDQVSNLVESLSDEFYLDEKRELFEIVKYAKQLHIERNMVDA

SEQ ID NO: 1394 - protein, 147 aa, Bacillus thuringiensis
MKLKNPDKHQSLSSNAKVDKIATDSLKNETDIELKNMNNEDYLRMSEHESIDPFVSASTIQTGIGIAGKILGTLGVPFAGQIASLYSFILGELWPKGKSQWEIFMEHVEEIINQKILTYARNKALSDLRGLGDALAVYHESLESWVE

SEQ ID NO: 1395 - protein, 719 aa, Bacillus thuringiensis
MKLKNPDKHQTLSSNAKVDKIATDSLKNETDIELKNMNNEDYLRMSEHESIDPFVSASTIQTGIGIAGKILGTLGVPFPGQIASLYSFILGELWPKGKSQWEIFMEHVEAIINRKISTYARNKALTDLKGLGDALAVYHESLESWVGNRNNTRARSVVKNQYIALELMFVQKLPSFAVSGEEVPLLPIYAQAANLHLLLLRDASIFEKNGGLSASEISTFYNRQVERTRDYSYHCVKWNNTGLNNLRATNGQSWVRYNQFRKDIELMVLDLVRVFPSYDTLVYPIKTTSQLTREVYTDAIGTVDPNQALRSTTWYNNNAPSFSAIEAAVIRSPHLLDFLEKVTIYSLLSRWSNTQYMNMWGGHRLESRPIGGALNTSTQGSTNTSINPVTLQFTSRDFYRTESWAGLNLFLTQPVIGVPRVDFHWKFPTLPIASDNFYYLGYAGVGTQLQDSENELPPETTGQPNYESYSHRLSHIGLISASHVKALVYSWTHRSADRTNTIEPNSITQIPLVKAFNLSSGAAVVRGPGFTGGHILRRTKSGTFGHIRVNINPPFAQRYRVRMSYASTTDLQFHTSINGKAINQGNFSATMNRGEDLDYKTFRTVGFTTPFSFSDVQSTFTIGAWNFSSGNEVYIGRIEFVPVEVTYEAEYDFEKAQEKVTALFTSTNPRGLKTDVKDYHIDQVSNLVESLSDELYLDEKRELFEIVKYAKQIHIERNM

SEQ ID NO: 1396 - protein, 381 aa, Bacillus thuringiensis; identical to SEQ ID NO: 225

SEQ ID NO: 1397 - protein, 150 aa, Bacillus thuringiensis
MEINNQKQCIPYNCLSNPEEVLLDGERILPDIDPLEVSLSLLQFLLNNFVPGGGFISGLVDKIWGALRPSEWDLFLAQIERLIDQRIEATVRAKAITELEGLGRNYQIYAEAFKEWESDPDNEAAKSRVIDRFRILDGLIEANIPSFRII

SEQ ID NO: 1398 - protein, 1170 aa, Bacillus thuringiensis
MEINNQNQCIPYNCLSNPEEVLLDGERILPDIDPLEVSMSLLQFLLNNFVPGGGFISGLFDKIWGALRPSDWELFLAQIEQLIDQRIEATVRAKAIAELEGLGRSFQLYVEAFKEWEETPDNTAARSRVTERFRIIDAQIEANIPSFRIPGFEVPLLSVYAQAANLHLALLRDSVIFGERWGLTTTNVNDIYNRQVKRIHEYSDHCVDTYKTELERLGFTSRAQWKIYNQFRRELTLTVLDIVAVFPNYDGKLYPIQTKSELTREIYTSPVSEYYYGAINNYNQNGIQTERQIRQPHLMDFFNTMTMYTSYNRREYYWSGLEMTAYFTGFAGPQVSFPLAGTRGDAAPPFNVRSVNDGIYRILSAPFYSAPFLGTSVLGSRGEEFMFALNNISPPPSARYRNPGTVDSLVSIPPQDNSVPPHRGSSHRLSHVTMRNSSPIFHWTHRSATTTNRINSDVITQIPMVKAYNLHAGATVVRGPGFTGGDILRRTSNGMVVTLRVDASAVRNQRYRIRFRYAATSNFYFVVRRGNLGVNGREIMKTMSTGEELKSASFVLGEFITPFNFFENQVPLQIEIQSLSPGGEVYLDKIEFIPADTTFEAEYDLERAQKAVNALFTSTNQRGLKTDVTDYHIDQVSNLVECLSDEFCLDEKRELSEKVKHAKRLSDERNLLQDPNFTSINGQLDRGWRGSTDITIQGGNDVFKENYVTLPGTFDECYPTYLYQKIDESKLKAYTRYELRGYIEDSQDLEVYLIRYNAKHETLNVPGTDSLRTLSVESQNGRCGELNRCMPHIKWNPDVDCSCRDGEKCAHHSHHFSLDIDVGCTDLQEDLGVWVVFKIKTQEGYARLGNLEFIEEKPLVGEALSRVKRAEKKWRDKREKLELETKRVYTEAKEAVDALFVDSQYDRLQADTNIGMIHAADKLVHRICETYLPELPFIPGINAIIFEELENRISTAFFLYEARNVINNGDFNNGLTCWNVKGHVDVQQSHHRSVLVIPEWEAEVSQKVRVCPGRGYILRVTAYKEGYGEGCVTIHEIEDNTDELKFRNCEEEGDYSNDTGTCNDYPASQGAAGCADVCNSRNVGYKDAYETNTSASVNYKPTYEEETYTDVREDNHCEYDRGYVNYPPLPAGYVTKELEYFPETDTVWIEIGETEGKFIVDSVELLLMEE

SEQ ID NO: 1399 - protein, 1168 aa, Bacillus thuringiensis; identical to SEQ ID NO: 227

SEQ ID NO: 1400 - protein, 725 aa, Bacillus thuringiensis
  SITE 55: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
  SITE 76: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
  SITE 477: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
  SITE 600: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
  SITE 604: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
  SITE 619: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
  SITE 623: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
  SITE 624: note = misc_feature - Xaa can be any naturally occurring amino acid
  SITE 636: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
  SITE 637: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
  SITE 647: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
  SITE 653: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
  SITE 712: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
MCGFTPTRSREQVAEISLGLTRFLLENLFPGSTFGFGLIDIIWGIFGPDQWSMFXEQIEQLIDQRIETVERNRANXNINWVINSYDVYIEALKEWENNPDNSASQERVRNRFRTTDDALITGIPLLAIPNFEIATLSVYVQAANLHLSLLRDAVFFGERWGLTQINVDDLYRRLTNNIRTNSDHCARWYNEGLDNISGLSRSINFQREVTISVLDIVALFPNYDIRTYPISTTSQLTREIFTSPIVVPNDFSVAYEGVRRAPHLFEFLEKLVIYTGDRSGIRHWAGHEITSRRTDSYHGIIRYPLYGTAANAESPYTLALQPSGSIYRTLSEPIFSQTGGLSPHRRRVVEGVEFSIVNNNVNPSSFVYRRKGSLDSFTELPPEDESVPPYIGYSHQLCHVGFGRTNVIFEPSNFARVPVFSWTHRSATPTNTIDPDRITQIPSVKASSLRNSTVVSGPGFTGGDIVRMGAVHQIYAXDLSMNVRPSVALSRYLIRLRYACRGSSNIVIHGPSIRFVSLPSTMSNDEPLTYQSFRYASITTPITRPIYNMFNLSISRISGVQNLFIDRIEFIPVDANFEAERDLERAQKAVNALFTSTNQXGLKXDVTDYHIDQVSNLVXCLSDXFCLDEKRELSEKXKHAKRLSDEXNLLQDXNFTGINRQVDRGWRGSTDITIQGGNDVFKENYVTLPGTFDECYPTYLYQKIDESKLKPXTRYELRGYIEDSQ

SEQ ID NO: 1401 - protein, 1170 aa, Bacillus thuringiensis; identical to SEQ ID NO: 1398

SEQ ID NO: 1402 - protein, 1167 aa, Bacillus thuringiensis
MTNPTILYPSYHNVLAHPIRLDSFFDPFVETFKDLKGAWEEFGKTGYMDPLKQHLQIAWDTSQNGTVDYLALTKASISLIGLIPGADAVVPFINMFVDFIFPKLFGRGSQQNAQAQFFELIIEKVKELVDEDFRNFTLNNLLNYLDGMQTALSHFQNDVQIAICQGEQPGLMLDQTPTACTPTTDHLISVRESFKDARTTIETALPHFKNPMLSTNDNTPDFNSDTVLLTLPMYTTGATLNLILHQGYIQFAERWKSVNYDESFINQTKVDLQRRIQDYSTTVSTTFEKFKPTLNPSNKESVNKYNRYVRSMTLQSLDIAATWPTLDNVNYPSNVDIQLDQTRLVFSDVAGPWEGNDNITSNIIDVLTPINTGIGFQESSDLRKFTYPRIELQSMQFHGQYVNSKSVEHCYSDGLKLNYKNKTITAGVSNIDESNQNNKHNYGPVINSPITDINVNSQNSQYLDLNSVMVNGGQKVTGCSPLSSNGNSNNAALPNQKINVIYSVQSNDKPEKHADTYRKWGYMSSHIPYDLVPENVIGDIDPDTKQPSLLLKGFPAEKGYGDSIAYVSEPLNGANAVKLTSYQVLQMEVTNQTTQKYRIRIRYATGGDTAASIWFHIIGPSGNDLTNEGHNFSSVSSRNKMFVQGNNGKYVLNILTDSIELPSGQQTILIQNTNSQDLFLDRIEFISLPSTSTPTSTNFVEPESLEKIINQVNQLFSSSSQTELAHTVSDYKIDQVVLKVNALSDDVFGVEKKALRKLVNQAKQLSKARNVLVGGNFEKGHEWALSREATMVANHELFKGDHLLLPPPTLYPSYAYQKIDESKLKSNTRYTVSGFIAQSEHLEVVVSRYGKEVHDMLDIPYEEALPISSDESPNCCKPAACQCSSCDGSQSDSHFFSYSIDVGSLQSDVNLGIEFGLRIAKPNGFAKISNLEIKEDRPLTEKEIKKVQRKEQKWKKAFNQEQAEVATTLQPTLDQINALYQNEDWNGSVHPASDYQHLSAVVVPTLPKQRHWFMEGREGEHVVLTQQFQQALDRAFQQIEEQNLIHNGNLANGLTDWTVTGDAQLTIFDEDPVLELAHWDASISQTIEIMDFEGRHRIQTACTWKRQRNSYRSTWRKRLETMTFNTTSFTTQEQTFYFEGDTVDVHVQSENNTFLIDSVELIEIIEE

SEQ ID NO: 1403 - protein, 1167 aa, Bacillus thuringiensis
MTNPTILYPSYHNVLAHPIRLDSFFDPFVETFKDLKGAWEEFGKTGYMDPLKQHLQIAWDTSQNGTVDYLALTKASISLIGLIPGADAVVPFINMFVDFIFPKLFGRGSQQNAQAQFFELIIEKVKELVDEDFRNFTLNNLLNYLDGMQTALSHFQNDVQIAICQGEQPGLMLDQTPTACTPTTDHLISVRESFKDARTTIETALPHFKNPMLSTNDNTPDFNSDTVLLTLPMYTTAATLNLILHQGYIQFAERWKSVNYDESFINQTKVDLQRRIQDYSTTVSTTFEKFKPTLNPSNKESVNKYNRYVRSMTLQSLDIAATWPTLDNVNYPSNVDIQLDQTRLVFSDVAGPWEGNDNITSNIIDVLTPINTGIGFQESSDLRKFTYPRIELQSMQFHGQYVNSKSVEHCYSDGLKLNYKNKTITAGVSNIDESNQNNKHNYGPVINSPITDINVNSQNSQYLDLNSVMVNGGQKVAGCSPLSSNGNSNNAALPNQKINVIYSVQSNDKPEKHADTYRKWGYMSSHIPYDLVPENVIGDIDPDTKQPSLLLKGFPAEKGYGDSIAYVSEPLNGANAVKLTSYQVLKMEVTNQTTQKYRIRIRYATGGDTAASIWFHIIGPSGNDLTNEGHNFSSVSSRNKMFVQGNNGKYVLNILTDSIELPSGQQTILIQNTNSQDLFLDRIEFISLPSTSTPTSTNFVEPESLEKIINQVNQLFSSSSQTELAHTVSDYKIDQVVLKVNALSDDVFGVEKKALRKLVNQAKQLSKARNVLVGGNFEKGHEWALSREATMVANHELFKGDHLLLPPPTLYPSYAYQKIDESKLKSNTRYTVSGFIAQSEHLEVVVSRYGKEVHDMLDIPYEEALPISSDESPNCCKPAACQCSSCDGSQSDSHFFSYSIDVGSLQSDVNLGIEFGLRIAKPNGFAKISNLEIKEDRPLTEKEIKKVQRKEQKWKKAFNQEQAEVATTLQPTLDQINALYQNEDWNGSVHPHVTYQHLSAVVVPTLPKQRHWFMEDREGEHVVLTQQFQQALDRAFQQIEEQNLIHNGNFANGLTDWTVTGDAQLTIFDEDPVLELAHWDASISQTIEIMDFEEDTEYKLRVRGKGKGTVTVQHGEEELETMTFNTTSFTTQEQTFYFEGDTVDVHVQSENNTFLIDSVELIEIIEE

SEQ ID NO: 1404 - protein, 2172 aa, Bacillus thuringiensis
ATGAAAGAACAAAATCTAAATAAATATGATGAAATAACTGTACAAGCAGCAAGCGATTATATCGACATTCGTCCGATTTTTCAAACAAATGGATCTGCTACATTTAATTCTAATACCAATATTACAACTTTAACACAAGCTATAAATAGTCAAGCAGGAGCAATTGCAGGAAAGACTGCTCTAGATATGAGACATGACTTTACTTTTAGAGCAGATATTTTTCTTGGAACTAAAAGTAACGGAGCAGACGGTATTGCAATCGCATTTCATAGAGGATCAATTGGGTTTGTTGGAACAAAAGGCGGAGGACTTGGAATATTAGGTGCACCTAAAGGGATAGGGTTTGAATTAGACACATATGCGAATGCACCTGAGGACGAAGTAGGCGATTCGTTTGGGCATGGGGCAATGAAAGGATCATTCCCTAGTTTCCCAAATGGATATCCCCATGCTGGCTTTGTAAGTACTGATAAAAATAGTAGATGGTTATCAGCTCTAGCTCAGATGCAGCGAATCGCTGCTCCAAACGGGCGTTGGAGACGTCTGGAGATTCGTTGGGATGCTCGTAATAAAGAGTTAACTGCAAATCTTCAGGATTTAACTTTTAATGACATAACTGTTGGAGAGAAGCCACGTACTCCAAGAACTGCAACTTGGAGGTTAGTAAATCCTGCATTTGAACTTGATCAGAAGTATACTTTTGTTATTGGTTCGGCGACGGGTGCATCTAATAACCTACATCAGATTGGGATTATAGAATTTGATGCATACTTTACTAAACCGACAATAGAAGCGAATAATGTAAATGTCCCAGTGGGAGCAACATTTAATCCAAAAACATATCCAGGAATAAATTTAAGAGCAACAGATGAGATAGATGGGGATTTGACATCGAAGATTATTGTGAAAGCAAACAATGTTAATACGTCGAAAACGGGTGTGTATTATGTGACGTATTATGTAGAGAATAGTTATGGGGAAAGTGATGAAAAAACAATCGAAGTAACTGTGTTTTCAAACCCTACAATTATTGCAAGTGATGTTGAAATTGAAAAAGGGGAATCTTTTAACCCACTAACTGATTCAAGAGTAGGTCTTTCTGCACAGGATTCATTAGGCAATGATATTACCCAAAATGTAAAGGTAAAATCGAGTAATGTGGATACTTCAAAGCCAGGGGAATATGAAGTTGTATTTGAAGTGACAGATAGCTTTGGTGGAAAAGCAGAAAAAGATTTCAAGGTTACAGTTTTAGGACAGCCAAGTATAGAAGCGAATAATGTTGAATTAGAAATAGATGATTCATTGGATCCATTAACAGATGCAAAAGTAGGTCTCCGTGCAAAGGATTCATTAGGTAATGATATTACGAAAGACATAAAAGTAAAGTTCAATAACGTAGATACTTCAAATTCAGGAAAGTATGAAGTTATATTTGAAGTGACGGACCGTTTTGGAAAAAAAGCAGAAAAAAGTATTGAAGTCCTTGTTCTAGGAGAACCAAGCATTGAAGCAAATGATGTTGAGGTTAATAAAGGTGAAACGTTTGAACCATTAACAGATTCAAGAGTTGGCCTCCGTGCAAAAGACTCATTAGGTAATGATATTACGAAAGATGTGAAAATAAAATCAAGTAATGTGGATACTTCAAAACCAGGTGAATATGAAGTTGTATTTGAAGTGACAGATCGTTTTGGTAAATATGTAGAAAAAACAATTGGAGTTATAGTGCCAGTAATTGATGATGAATGGGAAGATGGAAATGTGAATGGTTGGAAATTCTATGCTGGGCAAGATATTAAACTGTTGAAGGATCCTGATAAAGCCTATAAAGGCGATTATGTATTCTATGATTCTAGACACGTTGCTATTTCTAAAACAATTCCACTAACGGATTTGCAAATAAATACAAACTATGAAATTACAGTGTATGCTAAAGCAGAAAGCGGCGATCATCACTTAAAAGTGACGTATAAGAAAGACCCGGCAGGTCCAGAAGAGCCGCCAGTTTTCAATAGACTGATTAGCACAGGCACATTGGTAGAAAAAGATTATAGAGAATTAAAAGGGACGTTCCGCGTAACAGAATTAAACAAAGCACCATTGATAATCGTAGAGAATTTTGGAGCTGGATATATAGGTGGAATTAGAATTGTGAAAATATCGTAATAA

SEQ ID NO: 1405 - protein, 633 aa, Bacillus thuringiensis
MNSVLNSRRTTICDAYNVVAHDPFSFEHKSLDTIQKEWMEWKRTDHSLYVAPVVGTVSSFLLKKVGSLIGKRILSELWGIIFPSGSTNLMQDILRETEQFLNQRLNTDTLARVNAELIGLQANIREFNQQVDNFLNPTQNPVPLSITSSVNTMQQLFLNRLPQFQIQGYQLLLLPLFAQAANMHLSFIRDVILNADEWGISAATLRTYRDYLRNYTRDYSNYCINTYQTAFRGLNTRLHDMLEFRTYMFLNVFEYVSIWSLFKYQSLMVSSGANLYASGSGPQQTQSFTAQNWPFLYSLFQVNSNYILSGISGTRLSITFPNIGGLPGSTTTHSLNSARVNYSGGVSSGLIGATNLNHNFNCSTVLPPLSTPFVRSWLDSGTDREGVATSTNWQTESFQTTLSLRCGAFSARGNSNYFPDYFIRNISGVPLVIRNEDLTRPLHYNQIRNIESPSGTPGGARAYLVSVHNRKNNIYAANENGTMIHLAPEDYTGFTISPIHATQVNNQTRTFISEKFGNQGDSLRFEQSNTTARYTLRGNGNSYNLYLRVSSIGNSTIRVTINGRVYTVSNVNTTTNNDGVNDNGARFSDINIGNIVASDNTNVTLDINVTLNSGTPFDLMNIMFVPTNLSPLY

SEQ ID NO: 1406 - protein, 633 aa, Bacillus thuringiensis; identical to SEQ ID NO: 266

SEQ ID NO: 1407 - protein, 633 aa, Bacillus thuringiensis serovar israelensis
MNTVLNSGRTTICDAYNVAAHDPFSFQHKSLDTVQKEWTEWKKNNHSLYLDPIVGTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDMLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNLPPLY

SEQ ID NO: 1408 - protein, 633 aa, Bacillus thuringiensis
MNSVLNSGRTTICDAYNVAAHDPFSFQHKSLDTVQKEWTEWKKNNHSLYLDPIVGTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAASLHLSFIRDVILNADEWGISAATLRTYRDYLKNYTRDYSNYCINTYQSAFKGLNTRLHDMLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNLPPLY

SEQ ID NO: 1409 - protein, 633 aa, Bacillus thuringiensis
MNSVLNIGRTTICDAYNVAAHDPFSFQHKSLDTVQKEWTEWKKNNHSLYLDPIVGTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDMLEFRTYMFLNVFEYVSIWSLFKYQSLLVSPGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNIPPLY

SEQ ID NO: 1410 - protein, 633 aa, Bacillus thuringiensis
MNSVLNTGRTTICDAYNVAAHDPFSFQHKSLDTVQKEWTEWKKNNHSLYLDPIVGTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDMLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNISPLY

SEQ ID NO: 1411 - protein, 142 aa, Bacillus thuringiensis
MNNVLNSRRTTICDAYNVAAHDPFSFQHKSLDTVQKEWTEWKKNNHSLYLDPIVGTVASFLLKKVGSLVGKRILSELRNLIFPSGSTNLMQDILRETEKFLNQRLNTDTLARVNAELTGLQANVEEFNRQVDNFLNPNRNAV

SEQ ID NO: 1412 - protein, 632 aa, Bacillus thuringiensis
MNTVLNSGRTTICDAYNVAAHDPFSFQHKSLDTVQKEWTEWKKNNHSLYLDPIVGTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDMLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNLPPL

SEQ ID NO: 1413 - protein, 142 aa, Bacillus thuringiensis
MNTVLNSGRTTICDAYNVAAHDPFSFQHKSLDTVQKEWTEWKKNNHSLYLDPIVGTVASFLLKKVGSLVGKRILSELRNLIFPSGSTNLMQDILRETEKFLNQRLNTDTLARVNAELTGLQANVEEFNRQVDNFLNPNRNAV

SEQ ID NO: 1414 - protein, 633 aa, Bacillus thuringiensis
MNSVLNNGRTTICDAYNVAAHDPFSFQHKSLDTVQKEWTEWKKNNHSLYLDPIVGTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQSQMQGYQLLLLPLFAQAANLHLSFIRDVILNADEWGISAATLRTYRDYLKNYTRDYSNYCINTYQSAFKGLNTRLHDMLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNIPPLY

SEQ ID NO: 1415 - protein, 1902 aa, Bacillus thuringiensis
ATGAATAGTGTATTGAATAGCGGAAGAACTACTATTTGTGATGCGTATAATGTAGCGGCTCATGATCCATTTAGTTTTCAACACAAATCATTAGATACCGTACAAAAGGAATGGACGGAGTGGAAAAAAAATAATCATAGTTTATACCTAGATCCTATTGTTGGAACTGTGGCTAGTTTTCTGTTAAAGAAAGTGGGGAGTCTTGTTGGAAAAAGGATACTAAGTGAGTTACGGAATTTAATATTTCCTAGTGGTAGTACAAATCTAATGCAAGATATTTTAAGAGAGACAGAAAAATTCCTGAATCAAAGACTTAATACAGACACTGTTGCCCGTGTAAATGCGGAATTGACAGGGCTGCAAGCAAATGTAGAAGAGTTTAATCGACAAGTAGATAATTTTTTGAACCCTAACCGAAACGCTGTTCCTTTATCAATAACTTCTTCAGTTAATACAATGCAACAATTATTTCTAAATAGATTACCCCAGTTCCAGATGCAAGGATACCAACTGTTATTATTACCTTTATTTGCACAGGCAGCCAATTTACATCTTTCTTTTATTAGAGATGTTATTCTAAATGCAGATGAATGGGGAATTTCAGCAGCAACATTACGTACGTATCGAGATTACTTGAAAAATTATACAAGAGATTACTCTAACTATTGTATAAATACGTATCAAAGTGCGTTTAAAGGTTTAAACACTCGTTTACACGATATGTTAGAATTTAGAACATATATGTTTTTAAATGTATTTGAATATGTATCTATCTGGTCGTTGTTTAAATATCAAAGTCTTCTAGTATCTTCCGGTGCTAATTTATATGCAAGTGGTAGTGGACCACAGCAGACCCAATCATTTACTTCACAAGACTGGCCATTTTTATATTCTCTTTTCCAAGTTAATTCAAATTATGTGTTAAATGGATTTAGTGGTGCTAGGCTTTCTAATACCTTCCCTAATATAGTTGGTTTACCTGGTTCTACTACAACTCACGCATTGCTTGCTGCAAGGGTTAATTACAGTGGAGGAATTTCGTCTGGTGATATAGGTGCATCTCCGTTTAATCAAAATTTTAATTGTAGCACATTTCTCCCCCCATTGTTAACGCCATTTGTTAGGAGTTGGCTAGATTCAGGTTCAGATCGGGAGGGCGTTGCCACCGTTACAAATTGGCAAACAGAATCCTTTGAGACAACTTTAGGGTTAAGGAGTGGTGCTTTTACAGCTCGCGGTATTTCAAACTATTTCCCAGATTATTTTATTCGTAATATTTCTGGAGTTCCTTTAGTTGTTAGAAATGAAGATTTAAGAAGACCGTTACACTATAATGAAATAAGAAATATAGCAAGTCCTTCAGGAACACCTGGTGGAGCACGAGCTTATATGGTATCTGTGCATAACAGAAAAAATAATACCCATGCCGTTCATGAAAATGGTTCTATGATTCATTTAGCGCCAAATGACTATACAGGATTTACTATTTCGCCGATACATGCAACTCAAGTGAATAATCAAACACGAACATTTATTTCTGAAAAATTTGGAAATCAAGGTGATTCCTTAAGGTTTGAACAAAATAACACGACAGCTCGTTATACGCTTAGAGGGAATGGAAATAGTTACAATCTTTATTTAAGAGTTTCTTCAATAGGAAATTCCACTATTCGAGTTACTATAAACGGTAGGGTATATACTGCTACAAATGTTAATACTACTACAAATAACGATGGAGTTAATGATAACGGAGCTCGTTTTTCAGATATTAATATCGGTAATGTAGTAGCAAGTAGTAATTCTGATGTACCATTAGATATAAATGTAACATTAAACTCCGGTACTCAATTTGATCTTATGAATATTATGCTTGTACCAACTAATATTTCACCACTTTATTAA

SEQ ID NO: 1416 - protein, 633 aa, Bacillus thuringiensis
MNNVLNSGRNITCHAHNVVAHDPFSFEHKSLNTIEKEWKEWKRTDHSLYVAPIVGTVGSFLLKKVGSLVGKRILSELQNLIFPSGSIDLMQEILRATEQFINQRLNADTLGRVNAELAGLQANVAEFNRQVDNFLNPNQNPVPLAIIDSVNTLQQLFLSRLPQFQIQGYQLLLLPLFAQAANLHLSFIRDVILNADEWGISAATVRTYRDHLRNFTRDYSNYCINTYQTAFRGLNTRLHDMLEFRTYMFLNVFEYVSIWSLFKYQSLMVSSGANLYASGSGPQQTQSFTAQNWPFLYSLFQVNSNYILSGISGTRLSITFPNIGGLPGSTTTHSLNSARVNYSGGVSSGLIGATNLNHNFNCSTVLPPLSTPFVRSWLDSGTDREGVATSTNWQTESFQTTLSLRCGAFSARGNSNYFPDYFIRNISGVPLVIRNEDLTRPLHYNQIRNIESPSGTPGGARAYLVSVHNRKNNIYAANEYGTMIHLAPEDYTGFTISPIHATQVNNQTRTFISEKFGNQGDSLRFEQSNTTARYTLRGNGNSYNLYLRASSIGNSTIRVTINGRAYTVSNVNTTTNNDGVNDNGARFSDINIGNIVASDNTNVTLDINVTLNSGTPFDLMNIMFVPTNLPPLY

SEQ ID NO: 1417 - protein, 1152 aa, Bacillus thuringiensis
ATGTTAGATACTAATAAAGTTTATGAAATAAGTAATCATGCTAATGGACTATATGCAGCAACTTATTTAAGTTTAGATGATTCAGGTGTTAGTTTAATGAATAAAAATGATGATGATATTGATGATTATAACTTAAAATGGTTTTTATTTCCTATTGATGATGATCAATATATTATTACAAGCTATGCAGCAAATAATTGTAAAGTTTGGAATGTTAATAATGATAAAATAAATGTTTCGACTTATTCTTCAACAAATTCAATACAAAAATGGCAAATAAAAGCTAATGGTTCTTCATATGTAATACAAAGTGATAATGGAAAAGTCTTAACAGCAGGAACCGGTCAAGCTCTTGGATTGATACGTTTAACTGATGAATCCTCAAATAATCCCAATCAACAATGGAATTTAACTTCTGTACAAACAATTCAACTTCCACAAAAACCTATAATAGATACAAAATTAAAAGATTATCCCAAATATTCACCAACTGGAAATATAGATAATGGAACATCTCCTCAATTAATGGGATGGACATTAGTACCTTGTATTATGGTAAATGATCCAAATATAGATAAAAATACTCAAATTAAAACTACTCCATATTATATTTTAAAAAAATATCAATATTGGCAACGAGCAGTAGGAAGTAATGTAGCTTTACGTCCACATGAAAAAAAATCATATACTTATGAATGGGGAACAGAAATAGATCAAAAAACAACAATCATAAATACATTAGGATTTCAAATCAATATAGATTCAGGAATGAAATTTGATATACCAGAAGTAGGTGGAGGTACAGATGAAATAAAAACACAACTAAATGAAGAATTAAAAATAGAATATAGTCGTGAAACTAAAATAATGGAAAAATATCAAGAACAATCTGAAATAGATAATCCAACTGATCAACCAATGAATTCTATAGGATTTCTTACTATTACTTCTTTAGAATTATATAGATATAATGGCTCAGAAATTCGTATAATGCAAATTCAAACCTCAGATAATGATACTTATAATGTTACTTCTTATCCAGATCATCAACAAGCTTTATTACTTCTTACAAATCATTCATATGAAGAAGTAGAAGAAATAACAAATATTCCTAAAAGTACACTAAAAAAATTAAAAAAATATTATTTTTAA

SEQ ID NO: 1418 - protein, 1291 aa, Bacillus thuringiensis
GAAAGATCCAATTTTTTCACTTAATACTCTTCAGGAGTATGGACCAACTTTTTTGAGTATAGAAAACTCTATTCGAAAACCTCATTTATTTGATTATTTACAGGGGATTGAATTTCATACGCGTCTTCAACCTGGTTACTTTGGGAAAGATTCTTTCAATTATTGGTCTGGTAATTATGTAGAAACTAGACCTAGTATAGGATCTAGTAAGACAATTACTTCCCCATTTTATGGAGATAAATCTACTGAACCTGTACAAAAGCTAAGCTTTGATGGACAAAAAGTTTATCGAACTATAGCTAATACAGACGTAGCGGCTTGGCCGAATGGTAAGGTATATTTAGGTGTTACGAAAGTTGATTTTAGTCAATATGATGATCAAAAAAATGAAACTAGTACACAAACATATGATTCAAAAAGAAACAATGGCCATGTAAGTGCACAGGATTCTATTGACCAATTACCGCCAGAAACAACAGATGAACCACTTGAAAAAGCATATAGTCATCAGCTTAATTACGCGGAATGTTTCTTAATGCAGGACCGTCGTGGAACAATTCCATTTTTTACTTGGACACATAGAAGTGTAGACTTTTTTAATACAATTGATGCTGAAAAGATTACTCAACTTCCAGTAGTGAAAGCATATGCCTTGTCTTCAGGTGCTTCCATTATTGAAGGTCCAGGATTCACAGGAGGAAATTTACTATTCCTAAAAGAATCTAGTAATTCAATTGCTAAATTTAAAGTTACATTAAATTCAGCAGCCTTGTTACAACGATATCGTGTAAGAATACGCTATGCTTCTACCACTAACTTACGACTTTTTGTGCAAAATTCAAACAATGATTTTCTTGTCATCTACATTAATAAAACTATGAATAAAGATGATGATTTAACATATCAAACATTTGATCTCGCAACTACTAATTCTAATATGGGGTTCTCGGGTGATAAGAATGAACTTATAATAGGAGCAGAATCTTTCGTTTCTAATGAAAAAATCTATATAGATAAGATAGAATTTATCCCAGTACAATTGTAAGGAGATTTTAAAATGTTGGGTGATGGTCAAAATGAAAGAATAGGAAGGTGAATTTTGATGGTTAGGAAAGATTCTTTTAACAAAAGCAACATGGAAAAGTATACAGTACAAATATTAGAAATAAAATTTATTAACACAGGGGAAGATGGTAAACCAGAACCGTATGGTTATATTGACTTTTATTATCAACCTGCTCCTAACCTGAGAGAAGAAAAAGTAAGAATTTGGGAAGAGGAAAATAGTAGC

SEQ ID NO: 1419 - protein, 362 aa, Bacillus thuringiensis; identical to SEQ ID NO: 425

SEQ ID NO: 1420 - protein, 609 aa, Bacillus thuringiensis
MGTWWPTDSASDTWGEMIGFAQELVGTALSEDLKIRTNQQIDSIRIALQAYYSSLEDWLNANKPLSGPLLNQVTEEFGNALRKSRDSIAYFKSDDSNVYTIILLPAYAQVANFHLALIHEGLKYATEWNLPRLQTFGYEEDLKHYTISYVNHCEYWYQKGLDILYPRNVIGMTQWMKRNFYRLNMTINVLDIISLFSLYDSKKYPNFFEDIYNAQKELISKFQLTRIVTTEPTLHQHKYLNDSSKKICQNESSCDPIDLDEYLTLPLMFQNWLRNINFQYLAPVISVGDEALYPFFVATQNINEYMNAEGNMIIGRQQGLWNFQFIIVHLFHLVYKKMTIFMVKWLSAYPLIDEDILNGVRTPYILQKIEFYNLNKSINSKQIRPISAGTTKSPLIDIYYGLPDVNGYNLDEPQFNFNAASHYFNSIQTCYYKENTSKNHYDIYQSYVFHWEHASVKRKDEVVSDRITIFPAIKSNPILSRGIQIISHQGHTGGNVIYFTPQSELHFKINFVSNRQKYKIRLRYVAFNPVVIQYHGSNSYASLSSITLPRTSSNQNVRDLRYEEFGYSDFEINMSSAGGLEDIKIISNNEFILDRIEFIPDTLFNYLSN

SEQ ID NO: 1421 - protein, 837 aa, Bacillus thuringiensis
MKIYDIYPHYNVLSDAALITSYASDFRDSLKGLEEIWSKYATEGNRSAMTSYVSNIMQLYQTDSINYQALVKSAITLNLALTPLAPVSPFINMVIGFVRPFLFGSSKEVSMFDQIMDAVKKEMEHSFEQFTLNNLNDTINGLKTDLYDFTRLIDASTGVLQLPYESGEGCKPCKLGENSPCAPCYNDMIAINSKFQALTSSFNNALPHFKDPLANVIEKPNPGWNQEYITMCLPLYTLVATLELLTYQGYIQFAEKWRIPADSETSPITTTQIANMKANLRQRIQEHSNDIYTTFIKYLPKVNENATKGELNDYIRYHRVITLQCLDFVATWPFLDSRYYQSSGAATINFTRMTYLDIVGPVEDFYNDSKLDPSRDSGKLILSIKDINGKNDTNKISDVIAPLSLFYDNLELKSLKFNVYNSSWHCYINGYQGIYNSLSNDVSVSTNTNNLAKDLYLDFPLLNKLNMRSYAVGKASVDDSMVYVDDDSDVPSGNGHAIYGGCNGFYTGGPHSNNTLNYDNQIIQAIYEVTASNPNVYTYYYNADKTGYLATLSPIETTLSPIIGTDFQVINTVPAEQVISTSGTKFVEYITGSAVLELKPNQTAKYSILNQGLFQYKVRARVATTDSGSLSITMNNKTINLNIINTKNYTDPTTAFTNLKIQGKNGSYMVFPLSDAEHTTFDNVFNPNYGTVTMEVTNNSNTNIIIDRFEFIPYAPSKGTLLDTIPETIRTGGDSSILWKSTTGIGGQQVDLNIVIKDPSGIDVTTNYLLQYGSSYEFPLFSGQHSYPAVLNNEFTELGIDNCYGGNLGCNMNMPLKTIVPEGYTLTFSGNIYNNLK

SEQ ID NO: 1422 - protein, 1220 aa, Bacillus thuringiensis
MAILNELYPSVPYNVLAYTPPSFLPDAGTQATPADLTAYEQLLKNLEKGINAGTYSKAIADVLKGIFIDDTINYQTYVNIGLSLITLAVPEIGIFTPFIGLFFAALNKHDAPPPPNAKDIFEAMKPAIQEMIDRTLTADEQTFLNGEISGLQNLAARYQSTMDDIQSHGGFNKVDSGLIKKFTDEVLSLNSFYTDRLPVFITDNTADRTLLGLPYYAILASMHLMLLRDIITKGPTWDSKINFTPDAIDSFKTDIKNNIKLYSKTIYDVFQKGLASYGTPSDLESFAKKKKYIEIMTTHCLDFARLFPTFDPDLYPTGSGDISLQKTRRILSPFIPIRTADGLTLNNTSIDTSNWPNYENGNGAFPNPKERILKQFKLYPSWRAGQYGGLLQPYLWAIEVQDSVETRLYGQLPAVDPQAGPNYVSIDSSNPIIQINMDTWKTPPQGASGWNTNLMRGSVSGLSFLQRDGTRLSAGMGGGFADTIYSLPATHYLSYLYGTPYQTSDNYSGHVGALVGVSTPQEATLPNIIGQPDEQGNVSTMGFPFEKASYGGTVVKEWLNGANAMKLSPGQSIGIPITNVTKHNYQVRCRYASNSDNPVFFNVDTGGANPIFQQINFASTVDSNMGVKEENGVYVVKSIKTVEIPAGSFYVHVTNQGSSDLFLDRIEFVPKIQFQFCDNNNLHCDCNNPVDTDCTFCCVCTSLTDCDCNNPRGIDCTLCCQVENQLPSFVTLTDLRNITSQVNGLFAPGTQNRLAQNISDHDIEEVVLKVDALSDEIFGTNKKALRKLVNQAKRLSRARNLLIGGSFENWDAWYKGRNVVTVSDHELFKSDHVLLPPPGLSPSYIFQKVEESKLKANTRYTVSGFIAHATDLEIVVSRYGQEIKKVVQVPYGEAFPLTSSGPVCCIPHSTSNGTLGNPHFFSYSIDVGALDVDTNPGIEFGLRIVNPTGMARVSNLEIREDRPLAANEIRQVQRVARNWRTEYEKERAEVTSLIQPVINRINGLYENENWNGSIRSDISYQNIDAIVLPTLPTLRHWFMSDRFSEQGDIMAKFQGALNRAYAQLEQSTLLHNGHFTKDAANWTIEGDAHQITLEDGRRVLRLPDWSSSVSQMIEIENFNPDKEYNLVFHGQGEGTVTLEHGEETKYIETHTHHFANFTTSQRQGLTFESNKVTVTISSEDGEFLVDNIALVEAPLPTDDQNSEGNTAFSTNSDTSMNNNQ

SEQ ID NO: 1423 - protein, 3504 aa, Bacillus thuringiensis
ATGAGTCCAAATAATCAAAATGAATATGAAATTCTAGATGCTTCATCATCTACTTCTGTATCCGATAATTCTGTTAGATACCCTTTAGCAAACGATCAAACGACCACATTACAAAACATGAACTATAAAGATTATCTGAGAATGTCTGAGGGAGAGAATCCTGAATTATTTGGAAATCCGGAGACGTTTATTAGTTCATCTACGGTTCAAACTGGAATTGGCATTGTTGGTCAAGTACTGGGGGCTTTAGGGGTTCCATTTGCTGGACAGATAGCTAGTTTTTATAGTTTCATTGTCGGTCAATTATGGCCATCAAGTACCGTGAGTGTATGGGAAATGATTATGAAACAAGTGGAAGATCTAATTGATCAAAAAATAACAGATTCTGTAAGGAAAACAGCGCTTGCAGGACTACAAGGATTAGGAGATGGCTTAGACGTATATCAGAAATCACTTAAGAATTGGCTGGAAAATCGTAATGATACAAGAGCTAGAAGTGTTGTGGTGACCCAATATATAGCTTTAGAGCTTGATTTTGTTGCTAAAATCCCATCTTTTGCAATATCTGGACAGGAAGTACCATTATTATCAGTGTATGCACAAGCAGCGAATTTACATTTGCTATTATTACGAGATGCTTCCATTTTTGGAGCAGAGTGGGGATTCACACCAGGAGAAATTTCCACATTTTATGATCGTCAGGTGACACGTACCGCCCAATACTCGGATTATTGTGTAAAGTGGTATAACACTGGCTTAGATAAATTAAAAGGTACGAATGCTGCAAGTTGGCTGAAGTATCACCAATTCCGAAGAGAAATGACATTACTGGTATTAGATTTAGTAGCGTTATTTCCAAACTATGACACACGTACGTATCCAATCGAAACAACGGCCCAACTTACACGGGAAGTGTATACAGATCCAATAGTATTTAACAGAGAAACAAGTGGTGGATTTTGTAGGCGTTGGTCACTTAACAGTGATATTTCTTTTTCAGAAGTCGAAAGCGCTGTAATTCGTTCACCACACCTATTTGATATACTCAGTGAAATAGAATTTTATACAACAAGAGCGGGGCTTCCCTTGAATAATACGGAATACCTTGAATATTGGGTAGGACATTCTATAAAATATAAAAATACGAATGCCTCATCAGCATTAGAACGTAATTACGGTACGATTACTTCTAACAAAATCAAGTATTATGATTTAGCAAATAAGGATATCTTTCAGGTTCGATCATTAGGGGCGGATTTAGCTAATTACTACGCACAGGTATATGGAGTTCCGTACGCTAGTTTTACACTGCTTGACAAGAATACAGGATCAGGATCAGTTGGAGGTTTTACGTACTCAAAACCACATACAACTATGCAAGTATGTACACAAAATTACAATACGATTGATGAAATCCCTCCAGAGAATGAGCCACTTAGTAGAGGGTATAGCCATAGATTATCTCATATCACCTCTTATTCTTTTTCTAAGAATGCTAGTAGTCCTGCTAGATATGGCAATCTCCCTGTATTTGCTTGGACACATCGGAGTGCGGATGTTACAAATACAGTTTATTCAGATAAAATTACTCAGATACCAGTTGTAAAGGCACATACTTTAGTTTCAGGTACTACTGTTATTAAAGGTCCTGGATTTACAGGAGGCAATATCCTTAAAAGAACAAGTAGTGGTCCGTTAGCTTATACTAGTGTCTCTGTAAAATCACCATTATCACAAAGATATCGTGCAAGAATACGTTATGCTTCTACTACTAACTTACGACTTTTTGTAACAATTTCTGGAACTCGCATTTACTCTATAAATGTTAATAAAACCATGAATAAAGGGGATGATTTAACATTTAATACATTTGACTTAGCAACTATTGGTACTGCTTTCACATTTTCAAATTACTCGGATAGCTTAACGGTAGGTGCAGATTCTTTTGCTTCAGGAGGAGAAGTTTATGTAGATAAGTTCGAACTTATTCCGGTAAATGCAACATTTGAAGCAGAAGAAGACCTAGATGTGGCAAAGAAAGCAGTAAATGGCTTGTTTACGAGTAAAAAAGATGCCTTACAGACAAGTGTAACGGATTATCAAGTGAATCAAGCGGCAAACTTAGTAGAATGCCTATCCGATGAGTTATACCCAAATGAAAAACGAATGTTATGGGATGCAGTGAAAGAGGCGAAACGACTTGTTCAGGCACGTAACTTACTCCAAGATACAGGCTTTAATAGGATTAATGGAGAAAACGGATGGACGGGAAGTACGGGAATCGAGGTTGCGGAAGGAGATGTTCTGTTTAAAGATCGTTCGCTTCGTTTGACAAGTGCGAGAGAGATTGATACAGAAACATATCCAACGTATCTCTATCAACAAATAGATGAATCACTTTTAAAACCATATACAAGATATAAACTAAAAGGTTTTATAGGAAGTAGTCAAGATTTAGAGATTAAATTAATACGTCATCGGGCAAATCAAATCGTCAAAAATGTACCAGATAATCTCTTGCCAGATGTACTCCCTGTCAATTCTTGTGGTGGGATCGATCGCTGCAGTGAGCAACAGTATGTAGACGCGAATTTAGCACTCGAAAACAATGGAGAAAATGGAAATATGTCTTCTGATTCCCATGCATTTTCTTTCCATATTGATACAGGTGAAATAGATTTGAATGAAAATACAGGAATTTGGGTCGTATTTAAAATTCCGACAACAAATGGATACGCAACACTAGGAAATCTTGAATTGGTAGAAGAGGGGCCATTGTCAGGGGAAACATTAGAACGAGCACAACAACAAGAACAACAATGGCAAGACAAAATGGCAAGAAAACGTGGGGCATCAGAAAAAGCATATTATGCAGCAAAGCAAGCCATTGATCGTTTATTCGCAGATTATCAAGACCAAAAACTTAATTCTGGTGTAGAAATGTCAGATATGTTGGCAGCCCAAAACCTTGTACAGTCCATTCCTTACGTATATAATGATGCGTTACCAGAAATCCCTGGAATGAACTATACGAGTTTTACAGAGTTAACAAATAGACTCCAACAAGCATGGAATTTGTATGATCTTCGAAATGCTATACCAAATGGAGATTTTCGAAATGGATTAAGTGATTGGAATGCAACATCAGATGTGAATGTGCAACAACTAAGCGATACATCTGTCCTTGTCATTCCAAACTGGAATTCTCAAGTGTCACAACAATTTACAGTTCAACCGAATTATAGATATGTGTTACGTGTCACAGCGAGAAAAGAGGGAGTAGGAGACGGATATGTGATCATCCGTGATGGTGCGAATCAGACAGAAACACTCACATTTAATATATGTGATGATGATACAGGTGTTTTATCTGCTGATCAAACTAGCTATATCACAAAAACAGTGGAATTCACTCCATCTACAGAGCAAGTTTGGATTGACATGAGTGAGACCGAAGGTGTATTCAACATAGAAAGTGTAGAACTCGTGTTAGAAGAAGAGTAA

SEQ ID NO: 1424 - protein, 144 aa, Bacillus thuringiensis
MEGGNNQGFINIEGRLSLEQVLAVSAGVASYILSNLGPFGVFFSYIIGAFWPTAPSDTRVWEAFMELIEARIDQKIQESTRKDAIARLQGLGAASEVYQESLESWLENQNDARAMSVVRQQFVAFELDFVTAMPFFERSGDEIL

SEQ ID NO: 1425 - protein, 1154 aa, Bacillus thuringiensis
MNRNNQNEYEIIDGTNCGCSSDEVVKYPLTDDPNAGLQNMNYKEYLQTYDGDYTGSLINPNLSINTRDVLQTGINIVGRVLGFLGVPFAGQLVTFYTFLLNQLWPTNNNAVWEAFMAQIEELIDQRISEQVVRNALDALTGIHDYYNEYLAALEEWLERPNGARANLAFQRFENLHQLFVSQMPSFGSGPGSERDAVALLTVYAQAANLHLLLLKDAEIYGARWGLNQGQINLYFNAQQDRTQIYTNHCVATYNRGLENLRGTNTESWYNYHQFRREMTLMAMDLVALFPYYNLRQYPNGANPQLTREIYTDPVVFNPPANQGLCRRWRNNPYMTFSELENTFIRPPHLFDRLNSLTINSHRFPISSNFMDYWAGHTLRRSYMNNSAVQEDSYGATTSTRVTINTGVNGTNRIESTAVDFRSGLLGVYGVHRASFVPGGLFNGTISPANAGCRNLHDTRDELPLEENNGSPSHRLSHVTFLSFLTDQAGSIRNSGAVPLYVWARQDIDLNNTITANRITQLPLVKASEIAAGTTVVRGPGFTGGDILRRTSAGTLGTIRVNVNSPLTQRYRVRFRYASTTDFNFFVIRGGTTVNNFTFPRTMNSGQESRYESYVTREFSTSFNFLQIQDTLRLTVQSFSSGQQVYVDRIEIIPVNPTREAEEDLEAAKKAVANLFTHTRDGLQVNVTDYQVDQAANLVSCLSDEQYSHDKKMLLEAVRAAKRLSRERNLLQDPDFNEINTIEENGWKASNGVTISEGGPFFKGRALQLASARENNPTYIYQKVDASVLKPYTRYRLDGFVASSQDLELDLIHQHKVHLVKNVPDNLVSDSYSDGSCSGINRCEEQHLVDMQLDAEHHPMDCCEAAETHEFSSYIDTGDLNPSVDQGIWVVLKVRTTDGYATLGNLELVEVGPLSGESLEREQKDNAKWNAELGRKRAETDRVYQAAKQAINHLFVDYQDQQLNPEIGLAEMNEASNLLESIPGVYSDTVLQIPGVNYEIYTELSNRLQQASYLFMSRNAVQNGDFNNGLDSWNATTDATVQQDGTMHFLVLSHWDAQVSQPLRVQPNCKYVLRVTARKVGGGDGYVTIQDGAHHQETLTFNACDYDVNGTYVNDNTYITKEVVFYPETKHMWIEVSESEGAFYIDSIEFIEIQE

SEQ ID NO: 1426 - protein, 638 aa, Bacillus thuringiensis
EIIDGTNCGCSSDEVVKYPLTDDPNAGLQNMNYKEYLQTYDGDYTGSLINPNLSINTRDVLQTGINIVGRVLGFLGVPFAGQLVTFYTFLLNQLWPTNNNAVWEAFMAQIEELIDQRISEQVVRNALDALTGIHDYYNEYLAALEEWLERPNGARANLAFQRFENLHQLFVSQMPSFGSGPGSERDAVALLTVYAQAANLHLLLLKDAEIYGARWGLNQGQINLYFNAQQDRTQIYTNHCVATYNRGLENLRGTNTESWYNYHQFRREMTLMAMDLVALFPYYNLRQYPNGANPQLTREIYTDPVVFNPPANQGLCRRWRNNPYMTFSELENTFIRPPHLFDRLNSLTINSHRFPISSNFMDYWAGHTLRRSYMNNSAVQEDSYGATTSTRVTINTGVNGTNRIESTAVDFRSGLLGVYGVHRASFVPGGLFNGTISPANAGCRNLHDTRDELPLEENNGSPSHRLSHVTFLSFLTDQAGSIRNSGAVPLYVWARQDIDLNNTITANRITQLPLVKASEIAAGTTVVRGPGFTGGDILRRTSAGTLGTIRVNVNSPLTQRYRVRFRYASTTDFNFFVIRGGTTVNNFTFPRTMNSGQESRYESYVTREFSTSFNFLQIQDTLRLTVQSFSSGQQVYVD

SEQ ID NO: 1427 - protein, 249 aa, Bacillus thuringiensis
MENLNHCPLEDIKVNPWKTPQSTARVITLRVEDPNEINNLLSINEIDNPNYILQAIMLANAFQNALVPTSTDFGDALRFSMAKGLEIANTITPMGAVVSYVDQNVTQTNNQVSVMINKVLEVLKTVLGVALSGSVIDQLTAAVTNTFTNLNTQKNEAWIFWGKETANQTNYTYNVLFAIQNAQTGGVMYCVPVGFEIKVSAVKEQVLFFTIQDSASYNVNIQSLKFAQPLVSSSQYPIADLTSAINGTL

SEQ ID NO: 1428 - protein, 249 aa, Bacillus thuringiensis; identical to SEQ ID NO: 1427

SEQ ID NO: 1429 - protein, 249 aa, Bacillus thuringiensis; identical to SEQ ID NO: 520

SEQ ID NO: 1430 - protein, 250 aa, Bacillus thuringiensis
MENPNHCPLEDIQVNPWKTPQSKARVITLRIDDPNEINNLLSINEIENTNYLLQAIMLANAFQKALVPTSTEFAEDALQFSMTKGLEVANTISPPGAVVQYVDQNVSQTNNQVSAMINKVLDVLKSILGVALGQSVIEQLTSAVTNTFTNLNTQKNEAWIFWGRETSTQTNYTYNVLFAIQNGQTGGVMYCVPVGFEIKVSAVKERVLFLTIQDSASYNVNIQSLKFAQPLVSASEYPIADLTSAINGTL

SEQ ID NO: 1431 - protein, 265 aa, Bacillus thuringiensis
MKESIYYNEENEIQISQGNCFPEELGHNPWRQPQSTARVIYLKVKDPIDTTQLLEITEIENPNYVLQAIQLAAAFQDALVPTETEFGEAIRFSMPKGLEVAKTIQPKGAVVAYTDQTLSQSNNQVSVMIDRVISVLKTVMGVALSGSIITQLTAAITDTFTNLNTQKDSAWVFWGKETSHQTNYTYNVMFAIQNETTGRVMMCVPIGFEIRVFTDKRTVLFLTTKDYANYSVNIQTLRFAQPLIDSRALSINDLSEALRSSKYLY

SEQ ID NO: 1432 - protein, 525 aa, Bacillus thuringiensis
MAQSEFNQNLREQGQSRARVIILRVNNPGYNTNTLDIADIEDIIHLPQAIELANAFQSALVPTTSNFGEDTLRFDVERGLGIATHVYPRAINVNYVTRTLSQTNNQVQSMINKVIEELKSLLGINLANSVLQQLTTVITETFTNLYVQQQSAWLFWGRQTSSQTNYTYNIVFAIQNAQTGSFMKAIPIGFEISAYIARERLLFFNIQDYASYSVKIHAIQVMQPLIHESFQPLRGIFNIITSVNNRSAIQITEYYDENTHDYPVKLWDYNNIINQKWILVFNQTTRAYSIQNLIARYLVLTWDSTPGSNKVFASTNRWNDSQFWILESTADGSIFLTNMKDTQFVLEIENSSTTNGTNVIVNRKNNNAQQKFYLNKVNQEFQDGVYKIKTALNNSSVLQMSEDYFGYTSDYFVKLWTNNNNDINQKWIFEFDSTKSAYQIKSQRDPSLVLAWTWSVPTVKLPIPNNDDHLWFLQNAGSGTYYFVNMTDTRYVLEVASSSTTNGTILTINKRNGNLNQKFLLDMIN

SEQ ID NO: 1433 - protein, 259 aa, Bacillus thuringiensis
MYTKNFSNSRMEVKGNNGCSAPIIRKPFKHIVLTVPSSDLDNFNTVFYVQPQYINQALHLANAFQGAIDPLNLNFNFEKALQIANGIPNSAIVKTLNQSVIQQTVEISVMVEQLKKIIQEVLGLVINSTSFWNSVEATIKGTFTNLDTQIDEAWIFWHSLSAHNTSYYYNILFSIQNEDTGAVMAVLPLAFEVSVDVEKQKVLFFTIKDSARYEVKMKALTLVQALHSSNAPIVDIFNVNNYNLYHSNHKIIQNLNLSN

SEQ ID NO: 1434 - protein, 259 aa, Bacillus thuringiensis; identical to SEQ ID NO: 1433

SEQ ID NO: 1435 - protein, 259 aa, Bacillus thuringiensis
MYTKNFSNSRMEVKGNNGCSAPIIRKPFKHIVLTVPSSDLDNFNTVFYVQPQYINQALHLANAFQGAIDPLNLNFNFEKALQIANGIPNSAIVKTLNQSVIQQTVEISVMVEQLKKIIQEVLGLVINSTSFWNSVEATIKGTFTNLDTQIDEAWIFWHSLSAHNTSYYYNILFSIQNEDTGAVMAVLPLAFEVSVDVEKQKVLFFTIKDSARYEVKMKALTLVQALHSSDAPIVDIFNVNNYNLYHSNHKIIQNLNLSN

SEQ ID NO: 1436 - protein, 259 aa, Bacillus thuringiensis; identical to SEQ ID NO: 1433

SEQ ID NO: 1437 - protein, 263 aa, Bacillus thuringiensis
MHLNNLNNFNNLENNGEYHCSGPIIKKPFRHIALTVPSSDITNFNEIFYVEPQYIAQAIRLTNTFQGAIDPLTLNFNFEKALQIANGLPNAGVTGTINQSVIHQTIEVSVMISQIKEIIRSVLGLVINSANFWNSVVSAITNTFTNLEPQVDENWIVWRNLSATQTSYFYKILFSIQNEDTGRFMAILPIAFEITVDVQKQQLLFITIKDSARYEVKMKALTVVQALDSYNAPIIDVFNVRNYSLHRPNHNILQNLNVNPIKS

SEQ ID NO: 1438 - protein, 263 aa, Bacillus thuringiensis; identical to SEQ ID NO: 1437

SEQ ID NO: 1439 - protein, 263 aa, Bacillus thuringiensis; identical to SEQ ID NO: 1437

SEQ ID NO: 1440 - protein, 263 aa, Bacillus thuringiensis; identical to SEQ ID NO: 1437

SEQ ID NO: 1441 - protein, 246 aa, Bacillus thuringiensis
YHCSGPIIKKPFRHIALTVPSSDITNFNEIFYVEPQYIAQAIRLTNTFQGAIDPLTLNFNFEKALQIANGLPNAGVTGTINQSVIHQTIEVSVMISQIKEIIRSVLGLVINSANFWNSVVSAITNTFTNLEPQVDENWIVWRNLSATQTSYFYKILFSIQNEDTGRFMAILPIAFEITVDVQKQQLLFITIKDSARYEVKMKALTVVQALDSYNAPIIDVFNVRNYSLHRPNHNILQNLNVNPIKS

SEQ ID NO: 1442 - protein, 156 aa, Bacillus thuringiensis
NTFQGAIDPLTLNFNFEKALQIANGLPNAGVTGTINQSVIHQTIEVSVMISQIKEIIRSVLGLVINSANFWNSVVSAITNTFTNLEPQVDENWVVWRNLSATQTSYFYKILFSIQNEDTGRFMAILPIAFEITVDVQKQQLLFITIKDSARYEVKM

SEQ ID NO: 1443 - protein, 157 aa, Bacillus thuringiensis; identical to SEQ ID NO: 528

SEQ ID NO: 1444 - protein, 147 aa, Bacillus thuringiensis
MHLNNLNNFNNLENNGEYHCSGPIIKKPFRHIALTVPSSDITNFNEIFYVEPQYIAQAIRLTNTFQGAIDPLTLNFNFEKALQIANGLPNAGVTGTINQSVIHQTIEVSVMISQIKEIIRSVLGLVINSANFWNSVVSAITNTFTNL

SEQ ID NO: 1445 - protein, 263 aa, Bacillus thuringiensis; identical to SEQ ID NO: 1437

SEQ ID NO: 1446 - protein, 263 aa, Bacillus thuringiensis
MYTKNLNSLEINEDYQYSRPIIKKPFRHITLTVPSSDIASFNEIFYLEPQYVAQALRLTNTFQAAIDPLTLNFDFEKALQIANGLPNAGITGTLNQSVIQQTIEISVMISQIKEIIRNVLGLVINSTNFWNSVLAAITNTFTNLEPQVDENWIVWRNLSATHTSYYYKILFSIQNEDTGAFMAVLPIAFEITVDVQKQQLLFITIRDSARYEVKMKALTVVQLLDSYNAPIIDVFNVHNYGLYQSNHPNHHILQNLNLNKIKG

SEQ ID NO: 1447 - protein, 880 aa, Bacillus thuringiensis
MKNMKKKLASVVTCTLLAPMFLNGNVNAVYADSKTNQISTTQKNQQKEMDRKGLLGYYFKGKDFSNLTMFAPTRDSTLIYDQQTANKLLDKKQQEYQSIRWIGLIQSKETGDFTFNLSEDEQAIIEINGKIISNKGKEKQVVHLEKGKLVPIKIEYQSDTKFNIDSKTFKELKLFKIDSQNQPQQVQQDELRNPEFNKKESQEFLAKPSKINLFTQKMKREIDEDTDTDGDSIPDLWEENGYTIQNRIAVKWDDSLASKGYTKFVSNPLESHTVGDPYTDYEKAARDLDLSNAKETFNPLVAAFPSVNVSMEKVILSPNENLSNSVESHSSTNWSYTNTEGASVEAGIGPKGISFGVSVNYQHSETVAQEWGTSTGNTSQFNTASAGYLNANVRYNNVGTGAIYDVKPTTSFVLNNDTIATITAKSNSTALNISPGESYPKKGQNGIAITSMDDFNSHPITLNKKQVDNLLNNKPMMLETNQTDGVYKIKDTHGNIVTGGEWNGVIQQIKAKTASIIVDDGERVAEKRVAAKDYENPEDKTPSLTLKDALKLSYPDEIKEIEGLLYYKNKPIYESSVMTYLDENTAKEVTKQLNDTTGKFKDVSHLYDVKLTPKMNVTIKLSILYDNAESNDNSIGKWTNTNIVSGGNNGKKQYSSNNPDANLTLNTDAQEKLNKNRDYYISLYMKSEKNTQCEITIDGEIYPITTKTVNVNKDNYKRLDIIAHNIKSNPISSLHIKTNDEITLFWDDISITDVASIKPENLTDSEIKQIYSRYGIKLEDGILIDKKGGIHYGEFINEASFNIEPLQNYVTKYEVTYSSELGPNVSDTLESDKIYKDGTIKFDFTKYSKNEQGLFYDSGLNWDFKINAITYDGKEMNVFH

SEQ ID NO: 1448 - protein, 881 aa, Bacillus thuringiensis serovar entomocidus
  SITE 846: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
MKKKLASVVTCTLLAPMFLNGNVNAVYADSKTNQISTTQKNQQKEMDRKGLLGYYFKGKDFSNLTMFAPTRDSTLIYDQQTANKLLDKKQQEYQSIRWIGLIQSKETGDFTFNLSEDEQAIIEINGKIISNKGKEKQVVHLEKGKLVPIKIEYQSDTKFNIDSKTFKELKLFKIDSQNQPQQVQQDELRNPEFNKKESQEFLAKPSKINLFTQKMKREIDEDTDTDGDSIPDLWEENGYTIQNRIAVKWDDSLASKGYTKFVSNPLESHTVGDPYTDYEKAARDLDLSNAKETFNPLVAAFPSVNVSMEKVILSPNENLSNSVESHSSTNWSYTNTEGASVEAGIGPKGISFGVSVNYQHSETVAQEWGTSTGNTSQFNTASAGYLNANVRYNNVGTGAIYDVKPTTSFVLNNDTIATITAKSNSTALNISPGESYPKKGQNGIAITSMDDFNSHPITLNKKQVDNLLNNKPMMLETNQTDGVYKIKDTHGNIVTGGEWNGVIQQIKAKTASIIVDDGERVAEKRVAAKDYENPEDKTPSLTLKDALKLSYPDEIKEIEGLLYYKNKPIYESSVMTYLDENTAKEVTKQLNDTTGKFKDVSHLYDVKLTPKMNVTIKLSILYDNAESNDNSIGKWTNTNIVSGGNNGKKQYSSNNPDANLTLNTDAQEKLNKNRDYYISLYMKSEKNTQCEITIDGEIYPITTKTVNVNKDNYKRLDIIAHNIKSNPISSIHIKTNDEITLFWDDISITDVASIKPENLTDSEIKQIYSRYGIKLEDGILIDKKGGIHYGEFINEASFNIEPLQNYVTKYKVTYSSELGQNVSDTLESDKIYKDGTIKFDFTKYSXNEQGLFYDSGLNWDFKINAITYDGKEMNVFHRYNK

SEQ ID NO: 1449 - protein, 881 aa, Bacillus thuringiensis; identical to SEQ ID NO: 1448
  SITE 846: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.

SEQ ID NO: 1450 - protein, 834 aa, Bacillus thuringiensis tenebrionis
MKNMKKKLASVVTCMLLAPMFLNGNVNAVNADSKINQISTTQENQQKEMDRKGLLGYYFKGKDFNNLTMFAPTRDNTLMYDQQTANALLDKKQQEYQSIRWIGLIQRKETGDFTFNLSKDEQAIIEIDGKIISNKGKEKQVVHLEKEKLVPIKIEYQSDTKFNIDSKTFKELKLFKIDSQNQSQQVQLRNPEFNKKESQEFLAKASKTNLFKQKMKRDIDEDTDTDGDSIPDLWEENGYTIQNKVAVKWDDSLASKGYTKFVSNPLDSHTVGDPYTDYEKAARDLDLSNAKETFNPLVAAFPSVNVSMEKVILSPNENLSNSVESHSSTNWSYTNTEGASIEAGGGPLGLSFGVSVTYQHSETVAQEWGTSTGNTSQFNTASAGYLNANVRYNNVGTGAIYDVKPTTSFVLNNNTIATITAKSNSTALRISPGDSYPEIGENAIAITSMDDFNSHPITLNKQQVNQLINNKPIMLETDQTDGVYKIRDTHGNIVTGGEWNGVTQQIKAKTASIIVDDGKQVAEKRVAAKDYGHPEDKTPPLTLKDTLKLSYPDEIKETNGLLYYDDKPIYESSVMTYLDENTAKEVKKQINDTTGKFKDVNHLYDVKLTPKMNFTIKMASLYDGAENNHNSLGTWYLTYNVAGGNTGKRQYRSAHSCAHVALSSEAKKKLNQNANYYLSMYMKADSTTEPTIEVAGEKSAITSKKVKLNNQNYQRVDILVKNSERNPMDKIYIRGNGTTNVYGDDVTIPEVSAINPASLSDEEIQEIFKDSTIEYGNPSFVADAVTFKNIKPLQNYVKEYEIYHKSHRYEKKTVFDIMGVHYEYSIAREQKKAA

SEQ ID NO: 1451 - protein, 769 aa, Bacillus cereus
MKNMKKKLASVVTCTLLAPMFFNGNVNTAYADNKINQDSSKQEYQQKEMDRKGLLGYYFKDKDFSNLTMFSPTRYNTLIYDQQTANKLLDKKQQEYQSIRWIGLIQSNKTGDFTFELSDDECAIIEMDGKVISNKGKEKQVVHLEKGKLVPIKIEYQLDEPLNIDDEKFKGFKLLKVDNQKQLHQVQQDELRNPEFNKKESQEFLAKASKINLFTKKIKRDIDEGTDTDGDSIPDMWEENGYTIQNRIAVKWNDSLASKGYTKFVSNPLDSHTVGDPYTDYEKASRDLDLSNAKETFNPLVAAFPSVNVSMEKVILSPNKNLSNSVESHSSTNWSYTNTEGASVEAGIGPKGFSFGVSANYQHSETVAQEWGASIGDTTQLNTASAGYLNANVRYNNVGTGAIYDVKPTTSFVLEKNTIATITAKSNSTALSISPGESYPKKGQNGIAITSMDDFNSHPITLNKKQLDQVLTNNPIMLETDQTDGIYKIKDTHGNIVTGGTWNGVTQQIKAKTASIIVDDGKQVAEKRVAAKDYAYPEDKTPSLTLKDALKLSFPEEIKETDGLLYYNNKPIYESSVMTYLDGNTAKEVKKQINDKTGEFKDVQHLYAVKLTPKMNFTIKVPVAYDTAKQAVNLGGDNPWGAKGLLGTWVNAMVVDNSGDKAYKRVEPGYLLSPTLEFSEGSLDNLKKNYSFYVSMYVKSDKPFTLRINAGPYSTKRTIEASNDFKRVDIPAFYIEGFPIDTIRLEGSDYPSAIWWKDVSITEVSAVKK

SEQ ID NO: 1452 - protein, 784 aa, Bacillus laterosporus
MTYMKKKLVSVVTCTLLAPMFLNGNVNPVYADNQTNQLSTAQENQEKEVDRKGLLGYYFKGKEFNHLTLFAPTRDNTLIYDQQTVDSLLDKKQQEYQSIRWIGLIQSKETGDFTFNLSDDKNAIMEIDTKTISHKGQNKQVVHLEKGKLVPIKIEYQPDQIVNRDSKIFKEFKLFKVDSKQQSHQVQLDELRNPEFNKKETQQFLEKASKTNLFTQNMKRDEDATDTDGDSIPDLWEENGYTIQNKVAVKWDDSFAAKGYTKFVSNPFDSHTVGDPYTDYEKAARDLDLANAKETFNPLVAAFPSVNVNLEKVILSPNEDLSNSVESHSSTNWSYTNTEGVSIEAGSGPLGISYGVSANYQHSETVAKEWGTSTGNTSQFNTASAGYLNANVRYNNVGTGAIYEVKPTTGFVLDNDTVATITAKSNSTALSISPGESYPKKGQNGIAINTMDDFNSHPITLNKQQLDQIFNNKPLMLETNQADGVYKIKDTSGNIVTGGEWNGVIQQIQAKTASIIVDTGEGVSEKRVAAKDYDNPEDKTPSLSLKEALKLGYPEEIKEKDGLLYYNDKPIYESSVMTYLDENTAKEVKEQLNDITGKFKDVKQLFDVKLTPKMNFTIKLATLYDGAEDGSSPTDVGISSPLGEWAFKPDINNVEGGNTGKRQYQLSKNKDGYYYGMLALSPEVSNKLKKNYQYYISMSIKADAGVEPTVTVMDNLNCIVDKKLKLSSNGYQRFDILVDNSESHPINVMVIDLGVSSQDYNNYSKNIYIDDITITEVSAMKVKN

SEQ ID NO: 1453 - protein, 785 aa, Brevibacillus laterosporus
MTYMKKKLVSVVTCALLAPMFLNGNVNPVYADNQTNQLSTAQENQEKEVDRKGLLGYYFKGKEFNHLTLFAPTRDNTLIYDQQTVDFLLDKKQQEYQSIRWIGLIQSKETGDFTFNLSDDKNAIIEIDGKTISHKGQNKQVVHLEKGKLVPIKIEYQSDQIVNRDSKIFKEFKLFKVDSQQQSHQVQLDELRNPEFNKKETQQFLEKASKTNIFTQNMKRDEDATDTDGDSIPDLWEENGYTIQNKVAVKWDDSFAAKGYTKFVSNPFDSHTVGDPYTDYEKAARDLDLANAKETFNPLVAAFPSVNVNLEKVILSPNEDLSNSVESHSSTNWSYTNTEGASIEAGSGPLGISYGVSANYQHSETVAKEWGTSTGNTSQFNTASAGYLNANVRYNNVGTGAIYEVKPTTGFVLDNDTVATITAKSNSTALSISPGESYPKKGQNGIAINTMDDFNSHPITLNKQQLDQIFNNKPLMLETNQADGVYKIKDTSGNIVTGGEWNGVIQQIQAKTASIIVDTGEGVSEKRVAAKDYDNPEDKTPSLSLKEALKLGYPEEIKEKDGLLYYNDKPIYESSVMTYLDENTAKEVKEQLNDITGKFKDVKQLFDVKLTPKMNFTIKLATLYDGAEDGSSPTDVGISSPLGEWAFKPDINNVEGGNTGKRQYQLSKNKDGYYYGMLALSPEVSNKLKKNYQYYISMSIKADAGVEPTVTVMDNLLNGIVDKKLKLSSNGYQRFDILVDNSESHPINVMVIDLGVSSQDYNNYSKNIYIDDITITEVSAMKVKN

SEQ ID NO: 1454 - protein, 860 aa, Bacillus thuringiensis
MTYMKKKLVSVVTCTLLAPIFLTGNVHPVNADSKKSQPSTAQEKQEKPVDRKGLLGYFFKGKEFNHLTLFAPTRDNTLIYDQQTANSLLDTKQQEYQSIRWIGLIQSKETGDFTFNLSDDQNAIIEIDGKIISHKGQNKQVVHLEKGKLVPIKIEYQSDQILTRDSNIFKEFQLFKVDSQQHSHQVQLDELRNPDFNKKETQQFLEKAAKTNLFTQNMKRDTDDDDDTDTDGDSIPDLWEENGYTIQNKVAVKWDDSFAAKGYTKFVSNPLESHTVGDPYTDYEKAARDLDLANAKETFNPLVAAFPSVNVNLEKVILSPDENLSNSVESHSSTNWSYTNTEGASIEAGGGPLGISFGVSANYQHSETVAKEWGTSTGNTSQFNTASAGYLNANVRYNNVGTGAIYEVKPTTSFVLDKDTVATITAKSNSTALSISPGESYPKKGQNGIAINTMDDFNSHPITLNKQQLDQLLNNKPLMLETNQADGVYKIKDTSGNIVTGGEWNGVIQQIQAKTASIIVDTGESVSEKRVAAKDYDNPEDKTPSLSLKEALKLGYPEEIKEKDGLLYYKDKPIYESSVMTYLDENTAKEVEKQLQDTTGIYKDINHLYDVKLTPTMNFTIKLASLYDGAENNDVKNGPIGHWYYTYNTGGGNTGKHQYRSANPSANVVLSSEAKSKLDKNTNYYLSMYMKAESDTEPTIEVSGENSTITSKKVKLNSEGYQRVDILVPNSERNPINQIYVRGNNTTNVYWDDVSITNISAINPKTLTDEEIKEIYKDFSESKDWPWFNDVTFKNIKPLENYVKQYRVDFWNTNSDRSFNRIKDSYPVNEDGSVKVNMTEYNEGYPLRIESAYHLNISDL

SEQ ID NO: 1455 - protein, 860 aa, Bacillus thuringiensis; identical to SEQ ID NO: 1454

SEQ ID NO: 1456 - protein, 775 aa, Bacillus thuringiensis serovar israelensis
MKNMKKKLASVVTCTLLAPMFLNGNVNAVYADSKTNQISTTQKNQQKEMDRKGLLGYYFKGKDFSNLTMFAPTRDNTLIYDQQTANKLLDKKQQQYQSIRWIGLIQSKEKGDFTFNLSEDEQAIIEIDGKIISNKGKEKQVVHLEKEKLVPIKIEYQSDTKFNIDSKTFKEFKLFKIDSQNQSQQVKRDELRNPEFNKKESREFLAKASKTNFFMQKMKRDIDEDTDTDGDSIPDLWEENGYTIQNKVAVKWDDKFAQQGYVKYLSSPYQAHTVGDPYTDWEKAAGDIPKSNAAATRNPLVAAFPSINVDMRKMILSKDSNLSNSAEAHSNNSYTYANSEGASIEAGFGPKGFSFGVSANYQHTETVGSDWGNSKSNTEQFNSASAGYLNANVHYNNVGTGGIYDAQPTTSFILQDSTIATITAKSNATALSIPSGDRYPASKEGISLKTMDDFNSHPITLNKPQLDAVLNNEVIKINTDQTDGRYGIIGVDGKAEIGDRWSPIIDEIKGRTASIIIDPADGKALETRIAAKDYKNPEDKTPSLTIKEGLKIAYPESISEDKDGILFYEYKNDEGKVTKKQLSEENIMPYLDEDTSKEFERQLSDGSAKGLYDIKLTPKMNITIRLATVTLGFDDQFSAYPWENATWSDKFGNLRLGSLAIPQESKYTIPKDKVKPNYDYLITGYIKHDFTTDNESLGIVAFTKKDNFEMWNMGTSIFSQNSGGEFKKFTIKTQNISGDYILDSIQLMKRNNDVNKIDSYLDDISIIPIGPNKSR

SEQ ID NO: 1457 - protein, 871 aa, Brevibacillus laterosporus
MKYMKKGLSSVVIGTLFASMFLNGNVNAVYANSKTNQIATTTQASKDNQIDREGLLGYYFKGKDFNDLTLFAPTRDNTLIYDQQTANTLVDQKHQEYHSIRWIGLIQSSATGDFTFKLSDDENAIIELDGKVISEKGNNKQSVHLEKGQLVQIKIEYQSDDALHIDNKIFKELKLFKIDSQNHSQQVQQDELRNPEFNKKETQVFLKKASKTNLFTQKTKRDIDEDTDTDGDSIPDVWEENGYTIQNKVAVKWDDSLASKGYQKFTSNPLEAHTVGDPYSDYEKAARDMPLSNAKETFNPLVAAFPSVNVSLEKVILSKNEDLSHSVESSQSTNWSYTNTEGVNVNAGWSGLGPSFGVSVNYQHSETVANEWGSATNDGTHINGAESAYLNANVRYNNVGTGAIYETKPTTSFILDGTTIGTIKAKENTTALTILPDQSYPEKGKNGIAINTMDDFNSRPIPLNKEQLNTYLSNKKPILLETDQVEGKYAIKDTNGNITIAGDWNGITDEISAKTASIIVDNGNQMSEKRVAAKDYTNPEDKTPNLSVKEALKLAYPDEIEEKDGLLFYNDQPIFEASVQSYVDEYTAKQIRKQLNDSTGSFKDVKNLYDVKLEPKMNFTIKTSTLYDGGESDNTKIGNWYYTYVVNGGNTGKKQYRSANKGAFTELSTESKNKLKKNIDYYVSLYMKADSKVSVDIEIDGKQESIVTDNITLDHVGYQRINILVPNLEGNEINTISIKGDGQTNVYWDDVSFVEVGAEEIEYKDPVPQFDIIEGDFDFFGDPLAVKYHDATYFIDSPLITQTPGTFSFTYKVIGEQTKTVLDSGSGKNANRINLDFKNVKSDRSFLYTLSCKDDLWGSTRTAVVRIFAVD

SEQ ID NO: 1458 - protein, 280 aa, Bacillus thuringiensis
MKRMEGKLFMVSKKLQVVTKTVLLSTVFSISLLNNEVIKAEQLNINSQSKYTNLQNLKITDKVEDFKEDKEKAKEWGKEKEKEWKLTATEKGKMNNFLDNKNDIKTNYKEITFSMAGSFEDEIKDLKEIDKMFDKTNLSNSIITYKNVEPTTIGFNKSLTEGNTINSDAMAQFKEQFLDRDIKFDSYLDTHLTAQQVSSKERVILKVTVPSGKGSTTPTKAGVILNNSEYKMLIDNGYMVHVDKVSKVVKKGVECLQIEGTLKKSLDFKNDINAEAHSWG

SEQ ID NO: 1459 - protein, 446 aa, Bacillus thuringiensis
MFMVSKKLQVVTKTVLLSTVFSISLLNNEVIKAEQLNINSQSKYTNLQNLKITDKVEDFKEDKEKAKEWGKEKEKEWKLTATEKGKMNNFLDNKNDIKTNYKEITFSMAGSFEDEIKDLKEIDKMFDKTNLSNSIITYKNVEPTTIGFNKSLTEGNTINSDAMAQFKEQFLDRDIKFDSYLDTHLTAQQVSSKERVILKVTVPSGKGSTTPTKAGVILNNSEYKMLIDNGYMVHVDKVSKVVKKGVECLQIEGTLKKSLDFKNDINAEAHSWGMKNYEEWAKDLTDSQREALDGYARQDYKEINNYLRNQGGSGNEKLDAQIKNISDALGKKPIPENITVYRWCGMPEFGYQISDPLPSLKDFEEQFLNTIKEDKGYMSTSLSSERLAAFGSRKIILRLQVPKGSTGAYLSAIGGFASEKEILLDKDSKYHIDKVTEVIIKVLSDM

SEQ ID NO: 1460 - protein, 446 aa, Bacillus thuringiensis; identical to SEQ ID NO: 1459

SEQ ID NO: 1461 - protein, 462 aa, Bacillus thuringiensis tenebrionis
MQRMEGKLFVVSKTLQVVTRTVLLSTVYSITLLNNVVIKADQLNINSQSKYTNLQNLKIPDNAEDFKEDKGKAKEWGKEKGEEWRPPATEKGEMNNFLDNKNDIKTNYKEITFSMAGSCEDEIKDLEEIDKIFDKANLSSSIITYKNVEPATIGFNKSLTEGNTINSDAMAQFKEQFLGKDMKFDSYLDTHLTAQQVSSKKRVILKVTVPSGKGSTTPTKAGVILNNNEYKMLIDNGYVLHVDKVSKVVKKGMECLQVEGTLKKSLDFKNDINAEAHSWGMKIYEDWAKNLTASQREALDGYARQDYKEINNYLRNQGGSGNEKLDAQLKNISDALGKKPIPENITVYRWCGMPEFGYQISDPLPSLKDFEEQFLNTIKEDKGYMSTSLSSERLAAFGSRKIILRLQVPKGSTGAYLSAIGGFASEKEILLDKDSKYHIDKATEVIIKGVKRYVVDATLLTN

SEQ ID NO: 1462 - protein, 280 aa, Bacillus thuringiensis
MKRMEGKLFMVSTKLQAVTKAVLLSTVLSISLLNNEVIKAEQLNMNSQNKYTNFENLKITDKVEDFKEDKEKAKEWGKEKEKEWKLTATEKGKMNNFLDNKNDIKTNYKEITFSMAGSFEDEIKDLKEIDKIFDKANLSSPIITYKNVEPATIGFNKSLTEGNTINSDAMAQFKEQFLDRDIKFDSYLDTHLTVQQVSSKERVILKVKVPSGKGSTTPTKAGIILNNSEYKMLIDNGYMVHVDKVSKVVKKGVECLQVEGTLKKSLDFKNDINAGAHSWG

SEQ ID NO: 1463 - protein, 457 aa, Brevibacillus laterosporus
MIVIIFTNVKGGNELKKNFYKNLICMSALLLAMPISSNVTYAYGSEKVDYLVKTTNNTEDFKEDKEKAKEWGKEKEKEWKLTVTEKTRMNNFLDNKNDIKKNYKEITFSMAGSFEDEIKDLKEIDKMFDKANLSSSIVTYKNVEPSTIGFNKPLTEGNTINTDVQAQFKEQFLGKDIKFDSYLDTHLTAQNVSSKERIILQVTVPSGKGSTIPTKAGVILNNNEYKMLIDNGYVLHVDNISKVVKKGYECLQIQGTLKKSLDFKNDINAEAHRWGMKNYEGWAKNLTDPQREALDGYARQDYKQINDYLRNQGGSGNEKLDTQIKNISEALEKQPIPENITVYRWCGMAEFGYQISDPLPSLKEMEEKFLNTMKEDKGYMSTSLSSERLSAFGSRKFILRLQVPKGSTGAYLSAIGGFASEKEILIDKDSNYHIDKITEVVIKGVKRYVVDATLLTK

SEQ ID NO: 1464 - protein, 462 aa, Bacillus thuringiensis serovar israelensis
MQRMEGKLFMVSKKLQAVTKTVLLSTVLSISLLNNEEVKAEQLNINSQNKYTNFQNLKITDNAEDFKEDKEKAKEWGEEKEKEWKLTATEKGKMNNFLDNKNDIKTNYKEITFSMAGSFEDEIKDLKEIDKIFDKANLSSSIITYKNVEPATIGFNKSLTEGNTINSDAMAQFKEQFLGKDMKFDSYLDTHLTAHQVSSKKRVILKVTVPSGKGSTTPTKAGVILTNNEYKMLIDNGYVLHVDKVSKVVKKGMECLQVEGTLKKSLDFKNDINAEAHSWGMKIYEDWAKNLTASQREALDGYARQDYKEINNYLRNQGGSGNEKLDAQIKNISDALGKKPIPENITVYRWCGMPEFGYQISDPLPSLKDFEEQFLNTIKEDKGYMSTSLSSERLAAFGSRKIILRLQVPKGSTGAYLSAIGGFASEKEILLDKDSKYHIDKATEVIIKGVKRYVVDATLLTN

SEQ ID NO: 1465 - protein, 280 aa, Bacillus thuringiensis serovar israelensis
MKRMEGKLFMVSKKLQLVTKALLFSTVLSIPLLNNEEVKAEHLNLNSQSKYPSFQNQKITDNAEDFKEDKEKAKEWGEVKEKEWKLTATEKRKINDFLNDTNKIKTNYKEITFSMAGSFEDELKDLKEIDKMFDKANLSSSIITYKNVEPATIGFNKSLTEGNTINSDVMAQFKEQFLGKDIKFDSYLDTHLTVQQVSSKERVILKVTVPSGKGSTTPTKAGVILDGNEHKMLIDNGYVLHVDKVSKVVKRGLECLQVEGTLKKSLDFKNDISAKAHSWG

SEQ ID NO: 1466 - protein, 462 aa, Bacillus thuringiensis serovar israelensis
MKRMEGKLFMVSKKLQLVTKALLFSTVLSIPLLNNEEVKAEHLNLNSQSKYPSFQNQKITDNAEDFKEDKEKAKEWGEVKEKEWKLTATEKRKINDFLNDTNKIKTNYKEITFSMAGSFEDELKDLKEIDKMFDKANLSSSIITYKNVEPATIGFNKSLTEGNTINSDVMAQFKEQFLGKDIKFDSYLDTHLTVQQVSSKERVILKVTVPSGKGSTNPTKAGVILDGNEHKMLIDNGYVLHVDKVSKVVKKGLECLQVEGTLKKSLDFKNDISAKAHSWGMKNYEEWAANLTDSQRKALDGYARQDYKKINDYLRNQGGSGNEQLDAQIKNISETLNNKPIPENITVYRWCGMPEFGYQISEPLPALKDFEWEFLNTIKEDKGYISTSLSSERLAAFGSRKIILRLQIPKGSKGAYLSAIGGFANEKEILLDKDSKYHINKITEVVIKGIKRYVVDATLLTN

SEQ ID NO: 1467 - protein, 280 aa, Bacillus thuringiensis
MKRMEGKLFMVSRKLQLVTKALLFSTVLSIPLLNNEEVKAEHLNLNSQSKYPSFQNQKITDNAEDFKEDKEKAKEWGEVKEKEWKLTATEKRKINDFLNDTNKIKTNYKEITFSMAGSFEDELKDLKEIDKMFDKANLSSSIITYKNVEPATIGFNKSLTEGNTINSDVMAQFKEQFLGKDIKFDSYLDTHLTVQQVSSKERVILKVTVPSGKGSTNPTKAGVILDGNEPKMLIDNGYVLHVDKVSKVVKKGLECLQVEGTLKKSLDFKNDISAKAHSWG

SEQ ID NO: 1468 - protein, 462 aa, Bacillus thuringiensis
MKRMEGKLFMVSKKLQLVTKALLFSTVLSIPLLNNEEVKAEHLNLNSQSKYPSFQNQKITDNAEDFKEDKEKAKEWGEVKEKEWKLTATEKRKINDFLNDTNKIKTNYKEITFSMAGSFEDELKDLKEIDKMFDKANLSSSIITYKNVEPATIGFNKSLTEGNTINSDVMAQFKEQFLGKDIKFDSYLDTHLTVQQVSSKERVILKVTVPSGKGSTTPTKAGVILDGNEHKMLIDNGYVLHVDKVSKVVKRGLECLQVEGTLKKSLDFKNDISAKAHSWGMKNYEEWAANLTDSQRKALDGYARQDYKKINDYLRNQGGSGNEQLDAQIKNISETLNNKPIPENITVYRWCGMPEFGYQISEPLPALKDFEWEFLNTIKEDKGYISTSLSSERLAAFGSRKIILRLQIPKGSKGAYLSAIGGFANEKEILLDKDSKYHINKITEVVIKGIKRYVVDATLLTN

SEQ ID NO: 1469 - protein, 451 aa, Bacillus laterosporus
MVSKKLQLITKTLVFSTVLSIPLLNNSEIKAEQLNMNSQIKYPNFQNINIADKPVDFKEDKEKAREWGKEKEKEWKLTVTEKGKINDFLDDKDGLKTKYKEINFSKNFEYETELKELEKINTMLDKANLTNSIVTYKNVEPTTIGFNQSLIEGNQINAEAQQKFKEQFLGQDIKFDSYLDMHLTEQNVSSKERVILKVTVPSGKGSTPTKAGVVLNNNEYKMLIDNGYVLHVENITKVVKKGQECLQVEGTLKKSLDFKNDSDGKGDSWGKKNYKEWSDTLTTDQRKDLNDYGVRGYTEINKYLREGDTGNTELEEKIKNISDALEKNPIPENITVYRYCGMAEFGYPIKPEAPSVQDFEERFLDTIKEEKGYMSTSLSSDATSFGARKIILRLQVPKGSSGAYVAGLDGFKPAEKEILIDKGSKYRIDKVTEVVVKGTRKLVVDATLLTK

SEQ ID NO: 1470 - protein, 350 aa, Bacillus laterosporus
MKRMEERLFMVSKKLQLITKTLVFSTVLSIPLLNNSEIKAEQLNMNSQIKYPNFQNINIADKPVDFKEDKEKAREWGKEKEKEWKLTATEKGKINDFLDDKDGLKTKYKEINFSKNFEYETELKELEKINTMLDKANLTNSIVTYKNVEPTTIGFNQSLIEGNQINAEAQQKFKEQFLGQDIKFDSYLDMHLTEQNVSSKERVILKVTVPSGKGSTPTKAGVVLNNNEYKMLIDNGYVLHVENITKVVKKGQECLQVEGTLKKSLDFKNDSDGKGDSWGKKNYKEWSDTLTTDQRKDLNDYGARGYTEINKYLREGGTGNTELEEKIKNISDALEKNPIPENITVYRYCG

SEQ ID NO: 1471 - protein, 350 aa, Bacillus thuringiensis; identical to SEQ ID NO: 1470

SEQ ID NO: 1472 - protein, 350 aa, Bacillus thuringiensis serovar israelensis; identical to SEQ ID NO: 1470

SEQ ID NO: 1473 - protein, 789 aa, Bacillus thuringiensis
MNKNNTKLSTRALPSFIDYFNGIYGFATGIKDIMNMIFKTDTGGDLTLDEILKNQQLLNDISGKLDGVNGSLNDLIAQGNLNTELSKEILKIANEQNQVLNDVNNKLDAINTMLRVYLPKITSMLSDVMKQNYALSLQIEYLSKQLQEISDKLDIINVNVLINSTLTEITPAYQRIKYVNEKFEELTFATETSSKVKKDGSPADILDELTELTELAKSVTKNDVDGFEFYLNTFHDVMVGNNLFGRSALKTASELITKENVKTSGSEVGNVYNFLIVLTALQAQAFLTLTTCRKLLGLADIDYTSIMNEHLNKEKEEFRVNILPTLSNTFSNPNYAKVKGSDEDAKMIVEAKPGHALIGFEISNDSITVLKVYEAKLKQNYQVDKDSLSEVIYGDMDKLLCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGISQFIGDKLKPKTEYVIQYTVKGKPSIHLKDENTGYIHYEDTNNNLEDYQTINKRFTTGTDLKGVYLILKSQNGDEAWGDNFIILEISPSEKLLSPELINTNNWTSTGSTNISGNTLTLYQGGRGILKQNLQLDSFSTYRVYFSVSGDANVRIRNSREVLFEKRYMSGAKDVSEMFTTKFEKDNFYIELSQGNNLYGGPIVHFYDVSIK

SEQ ID NO: 1474 - protein, 789 aa, Bacillus thuringiensis; identical to SEQ ID NO: 1473

SEQ ID NO: 1475 - protein, 746 aa, Bacillus thuringiensis
MNKNNAKLSTRALPSFIDYFNGIYGFATGIKDIMNMIFKTDTGGDLALDEILENQQLLNDISGKLDGVNGSLNDLIAQGNLNTELSKEILKIANEQNQVLNDVNNKLDAINTMLRVYLPKITSMLSDVMKQNYALSLQIEYLSKQLQEISDKLDIINVNVLINSTLTEITPAYQRIKYVNEKFEELTFATETSSKVKKDGSPADIRDELSELTELAKSVTQNDVDGFEFYLNTFHDVMVGNNLFGRSALKTASELITKENVKTSGSEVGNVYNFLIVLTALQAQAFLTLTPCRKLLGLADIDYTSIMNEHLNKEKEEFRVNILPTLSNTFSNPNYAKVKGSDEDAKMIVEAKPGHALIGFEISNDSITVLKVYEAKLKQNYQVDKDSLSEVIYGDMDKLLCPDQSGQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGISQFIGDKLKPKTEYVIQYTVKGKPSIHLKDENTGYIHYEDTNNNLEDYQTINKRFTTGTDLKGVYLILKSQNGDEAWGDNFIILEISPSEKLLSPELINTNNWTSTGSTNISGNTLTLYQGGRGILKQNLQLDSFSTYRVYFSVSGDANVRIRNSREVLFEKKDI

SEQ ID NO: 1476 - protein, 790 aa, Bacillus thuringiensis
MNKNNTKLSTRALPSFIDYFNGIYGFATGIKDIMNMIFKTDTGGDLTLDEILKNQQLLNDISGKLDGVNGSLNDLIAQGNLNTELSKEILKIANEQNQVLNDVNNKLDAINTMLRVYLPKITSMLSDVMKQNYALSLQIEYLSKQLQEISDKLDIINVNVLINSTLTEITPAYQRIKYVNEKFEELTFATETSSKVKKDGSPANILDELTELTELAKSVTKNDVDGFEFYLNTFHDVMVGNNLFGRSALKTASELITKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALIGFEISNDSITVLKVYEAKLKQNYQVDKDSLSEVIYGDMDKLLCPDQSEQIYYTNNIVFPNEYVITKIDFTKKMKTLRYEVTANFYDSSTGEIDLNKKKVESSEAEYKTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGISQFIGDNLKPKTEYVIQYTVKGKPSIHLIDENTGYIHYEDTNNNLEDYQTINKRFTTGTDLKGVYLILKSQNGDEAWGDNFIILEISPSEKLLSPELINTNNWTSTGSTNISGNTLTLYQGGRGILKQNLQLDSFSTYRVYFSVSGDANVRIRNSREVLFEKRYMSGAKDVSEMFTTKFEKDNFYIELSQGNNLYGGPIVHFYDVSIKP

SEQ ID NO: 1477 - protein, 789 aa, Bacillus thuringiensis
MNKNNTKLSTRALPSFIDYFNGIYGFATGIKDIMNMIFKTDTGGDLTLDEILKNQQLLNDISGKLDGVNGSLNDLIAQGNLNTELSKEILKIANEQNQVLNDVDNKLDAINTMLRVYLPKITSMLSDVMKQNYALSLQIEYLSKQLQEISDKLDIINVNVLINSTLTEITPAYQRIKYVNEKFEELTFATETSSKVKKDGSPADILDELTELTELAKSVTKNDVDGFEFYLNTFHDVMVGNNLFGRSALKTASELITKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEISNDSITVLKVYEAKLKQNYQVDKDSLSEVIYGDMDKLLCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFIKNIVENGSIEEDNLEPWKANNKNEYVDHTGGVNGTKALYVHKDGGISQFIGDKLKPKTEYVIQYTVKGKPSIHLKDENTGYIHYEDTNNNLEDYQTITKRFTTGTDLKGVYLILKSQNGDEAWGDNFIILEISPSEKLLSPELINTNNWTSTGSTNISGNTLTLYQGGRGILKQNLQLDSFSTYRVYFSVSGDANVRIRNSREVLFEKRYMSGAKDVSEIFTTKFGKDNFYIELSQGNNLNGGPIVQFPDVSIK

SEQ ID NO: 1478 - protein, 790 aa, Bacillus thuringiensis
MNKNNTKLSTRALPSFIDYFNGIYGFATGIKDIMNMIFKTDTGGDLTLDEILKNQQLLNDISGKLDGVNGSLNDLIAQGNLNTELSKEILKIANEQNQVLNDVNNKLDAINTMLRVYLPKITSMLSDVMKQNYALSLQIEYLSKQLQEISDKLDIINVNVLINSTLTEITPAYQRIKYVNEKFEELTFATETSSKVKKDGSPADILDELTELTELAKSVTKNDVDGFEFYLNTFHDVMVGNNLFGRSALKTASELITKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALIGFEISNDSITVLKVYEAKLKQNYQVDKDSLSEVIYGDMDKLLCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGISQFIGDKLKPKTEYVIQYTVKGKPSIHLKDENTGYIHYEDTNNNLEDYQTINKRFTTGTDLKGVYLILKSQNGDEAWGDNFIILEISPSEKLLSPELINTNNWTSTGSTNISGNTLTLYQGGRGILKQNLQLDSFSTYRVYFSVSGDANVRIRNSREVLFEKRYMSGAKDVSEMFTTKFEKDNFYIELSQGNNLYGGPIVHFYDVSIKP

SEQ ID NO: 1479 - protein, 789 aa, Bacillus thuringiensis
MNKNNTKLSTRALPSFIDYFNGIYGFATGIKDIMNMIFKTDTGGDLTLDEILKNQQLLNDISGKLDGVNGSLNDLIAQGNLNTELSKEILKIANEQNQVLNDVNNKLDAINTMLRVYLPKITSMLSDVMKQNYALSLQIEYLSKQLQEISDKLDIINVNVLINSTLTEITPAYQRIKYVNEKFEELTFATETSSKVKKDGSPADILDELTELTELAKSVTKNDVDGFEFYLNTFHDVMVGNNLFGRSALKTASELITKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALIGFEISNDSITVLKVYEAKLKQNYQVDKDSLSEVIYGDMDKLLCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGISQFIGDKLKPKTEYVIQYTVKGKPSIHLKDENTGYIHYEDTNNNLEDYQTINKRFTTGTDLKGVYLILKSQNGDEAWGDNFIILEISPSEKLLSPELINTNNWTSTGSTNISGNTLTLYQGGRGILKQNLQLDSFSTYRVYFSVSGDANVRIRNSREVLFEKRYMSGAKDVSEMFTTKFEKDNFYIELSQGNNLYGGPIVHFYDVSIK

SEQ ID NO: 1480 - protein, 789 aa, Bacillus thuringiensis; identical to SEQ ID NO: 1479

SEQ ID NO: 1481 - protein, 789 aa, Bacillus thuringiensis
MNKNNTKLSTRALPSFIDYFNGIYGFATGIKDIMNMIFKTDTGGDLTLDEILKNQQLLNDISGKLDGVNGSLNDLIAQGNLNTELSKEILKIANEQNQVLNDVNNKLDAINTMLRVYLPKITSMLSDVMKQNYALSLQIEYLSKQLQEISDKLDIINVNVLINSTLTEITPAYQRIKYVNEKFEELTFATETSSKVKKDGSPADILDELTELTELAKSVTKNDVDGFEFYLNTFHDVMVGNNLFGRSALKTASELITKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALIGFEISNDSITVLKVYEAKLKQNYQVDKDSLSEVIYGDMDKLLCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGISQFIGDKLKPKTEYVIQYTVKGKPSIHLKDENTGYIHYEDTNNNLEDYQTINKRFTTGTDLKGVYLILKSQNGDEAWGDNFIILEISPSEKLLSPELINTNNWTSTGSTNISGNTLTLYQGGRGILKQNLQLDSFSTYRVYFSVSGDANVRIRNSREVLFGKRYMSGAKDVSEMFTTKFEKDNFYIELSQGNNLYGGPIVHFYDVSIK

SEQ ID NO: 1482 - protein, 789 aa, Bacillus thuringiensis; identical to SEQ ID NO: 1479

SEQ ID NO: 1483 - protein, 789 aa, Bacillus thuringiensis; identical to SEQ ID NO: 1479

SEQ ID NO: 1484 - protein, 789 aa, Bacillus thuringiensis; identical to SEQ ID NO: 1479

SEQ ID NO: 1485 - protein, 789 aa, Bacillus thuringiensis
MNKNNTKLSTRALPSFIDYFNGIYGFATGIKDIMNMIFKTDTGGDLTLDEILKNQQLLNDISGKLDGVNGSLNDLIAQGNLNTELSKEILKIANEQNQVLNDVNNKLDAINTMLRVYLPKITSMLSDVMKQNYALSLQIEYLSKQLQEISDKLDIINVNVLINSTLTEITPAYQRIKYVNEKFEELTFATETSSKVKKDGSPADILDELTELTELAKSVTKNDVDGFEFYLNTFHDVMVGNNLFGRSALKTASELITKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALIGFEISNDSITVLKVYEAKLKQNYQVDKDSLSEVIYGDMDKLLCPDQSEQIYYTNNIVFPNEYVITKIDFTKKMKTLRYEVTANFYDSSTGEIDLNKKKVESSEAEHRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGISQFIGDKLKPKTEYVIQYTVKGKPSIHLKDENTGYIHYEDTNNNLEDYQTINKRFTTGTDLKGVYLILKSQNGDEAWGDNFIILEISPSEKLLSPELINTNNWTSTGSTNISGNTLTLYQGGRGILKQNLQLDSFSTYRVYFSVSGDANVRIRNSREVLFEKRYMSGAKDVSEMFTTKFEKDNFYIELSQGNNLYGGPIVHFYDVSIK

SEQ ID NO: 1486 - protein, 789 aa, Bacillus thuringiensis
MNKNNTKLSTRALPSFIDYFNGIYGFATGIKDIMNMIFKTDTGGDLTLDEILKNQQLLNDISGKLDGVNGSLNDLIAQGNLNTELSKEILKIANEQNQVLNDVNNKLDAINTMLRVYLPKITSMLSDVMKQNYALSLQIEYLSKQLQEISDKLDIINVNVLINSTLTEITPAYQRIKYVNEKFEELTFATETSSKVKKDGSPADILDELTELTGLAKSVPKNDVDGFEFYLNTFHDVMVGNNLFGRSALKTASELITKENVKTSGSEVGNVYNSLIVLTLLQAKAFLTLTTCRKLLGLADIDYTSIMNEHLNKEKEEFRVNIPPTLSNTFSNPNYAKVKGSDEDAKMIVEAKPGHALVGFEISNDSITVLKVYEAKLKQNYQVDKDSLSEVIYGDMDKLLGPDQSGPIYYPNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFIKNIVENGSIEEDNLEPWKANNKNAYVDHTGGVNGTKALYVHKDGGISQFIGDKLKPKTEYVIQYTVKGKPSIHLKDENTGYIHYEDTNNNLEDYQTITKRFTTGTDLKGVYLILKSQNGDEAWGDNFIILEISPSEKLLSPELINTNNWTSTGSTNISGNTLTLYQGGRGILKQNLQLDSFSTYRVYFSVSGDANVRIRNSREVLFEKRYMSGAKDVSEIFTTKLGKDNFYIELSQGNNLNGGPIVKFYDVSIK

SEQ ID NO: 1487 - protein, 789 aa, Bacillus thuringiensis; identical to SEQ ID NO: 1479

SEQ ID NO: 1488 - protein, 789 aa, Bacillus thuringiensis
MNKNNTKLSTRALPSFIDYFNGIYGFATGIKDIMNMIFKTDTGGDLTLDEILKNQQLLNDISGKLDGVNGSLNDLIAQGNLNTELSKEILKIANEQNQVLNDVNNKLDAINTMLRVYLPKLTSMLSDVMKQNYALSLQIEYLSKQLQEISDKLDIINVNVLINSTLTEITPAYQRIKYVNEKFEELTFATETSSKVKKDGSPADILDELTELTELAKSVTKNDVDGFEFYLNTFHDVMVGNNLFGRSALKTASELITKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALIGFEISNDSITVLKVYEAKLKQNYQVDKDSLSEVIYGDMDKLLCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGISQFIGDKLKPKTEYVIQYTVKGKPSIHLKDENTGYIHYEDTNNNLEDYQTINKRFTTGTDLKGVYLILKSQNGDEAWGDNFIILEISPSEKLLSPELINTNNWTSTGSTNISGNTLTLYQGGRGILKQNLQLDSFSTYRVYFSVSGDANVRIRNSREVLFEKRYMSGAKDVSEMFTTKFEKDNFYIELSQGNNLYGGPIVHFYDVSIK

SEQ ID NO: 1489 - protein, 790 aa, Bacillus thuringiensis; identical to SEQ ID NO: 1478

SEQ ID NO: 1490 - protein, 789 aa, Bacillus thuringiensis
MNKNNTKLSTRALPSFIDYFNGIYGFATGIKDIMNMIFKTDTGGDLTLDEILKNQQLLNDISGKLDGVNGSLNDLIAQGNLNTELSKEILKIANEQNQVLNDVNNKLDAINTMLRVYLPKITSMLSDVMKQNYALSLQIEYLSKQLQEISDKLDIINVNVLINSTLTEITPAYQRIKYVNEKFEELTFATETSSKVKKDGSPADILDELTELTELAKSVTKNDVDGFEFYLNTFHDVMVGNNLFGRSALKTASELITKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALIGFEISNDSITVLKVYEAKLKQNYQVDKDSLSEVIYGDMDKLLCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGISQFIGDKLKPKTEYVIQYTVKGKTSIHLKDENTGYIHYEDTNNNLEDYQTINKRFTTGTDLKGVYLILKSQNGDEAWGDNFIILEISPSEKLLSPELINTNNWTSTGSTNISGNTLTLYQGGRGILKQNLQLDSFSTYRVYFSVSGDANVRIRNSREVLFEKRYMSGAKDVSEMFTTKFEKDNFYIELSQGNNLYGGPIVHFYDVSIK

SEQ ID NO: 1491 - protein, 789 aa, Bacillus thuringiensis
MNKNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGYALVGFEMSNDSITVLKVYEAKLKQNYQVDKDSLSEVIYGDTDKLLCPDQSEQIYYTNNIVFPNEYVITKIDFTKKMKTLRYEVTANFYDSSTGEIDLNKKKVESSEAEYRTLSANDDGVYMPLGVISETFLTPINGFGLQADGNSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDNFIILEISPSEKLLSPELINTNNWTSTGSTHISGNTLTLYQGGRGILKQNLQLDSFSTYRVYFSVSGDANVRIRNSREVLFEKRYMSGAKDVSEMFTTKFEKDNFYIELSQGNNLYGGPIVHFYDVSIK

SEQ ID NO: 1492 - protein, 789 aa, Bacillus thuringiensis; identical to SEQ ID NO: 1473

SEQ ID NO: 1493 - protein, 789 aa, Bacillus thuringiensis
MNKNNTKLSTRALPSFIDYFNGIYGFATGIKDIMNMIFKTDTGGDLTLDEILKNQQLLNDISGKLDGVNGSLNDLIAQGNLNTELSKEILKIANEQNQVLNDVNNKLDAINTMLRVYLPKITSMLSDVIKQNYALSLQIEYLSKQLQEISDKLDIINVNVLINSTLTEITPAYQRIKYVNEKFEELTFATETSSKVKKDGSPADILDELTELTELAKSVTKNDVDGFEFYLNTFHDVMVGNNLFGRSALKTASELITKENVKTSGSEVGNVYNFLIVLTALQAQAFLTLTTCRKLLGLADIDYTSIMNEHLNKEKEEFRVNILPTLSNTFSNPNYAKVKGSDEDAKMIVEAKPGHALIGFEISNDSITVLKVYEAKLKQNYQVDKDSLSEVIYGDMDKLLCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGISQFIGDKLKPKTEYVIQYTVKGKPSIHLKDENTGYIHYEDTNNNLEDYQTINKRFTTGTDLKGVYLILKSQNGDEAWGDNFIILEISPSEKLLSPELINTNNWTSTGSTNISGNTLTLYQGGRGILKQNLQLDSFSTYRVYFSVSGDANVRIRNSREVLFEKRYMSGAKDVSEMFTTKFEKDNFYIELSQGNNLYGGPIVHFYDVSIK

SEQ ID NO: 1494 - protein, 789 aa, Bacillus thuringiensis; identical to SEQ ID NO: 1479

SEQ ID NO: 1495 - protein, 789 aa, Bacillus thuringiensis
MNKNNTKLSTRALPSFIDYFNGIYGFATGIKDIMNMIFKTDTGGDLTLDEILKNQQLLNDISGKLDGVNGSLNDLIAQGNLNTELSKEILKIANEQNQVLNDVNNKLDAINTMLRVYLPKITSMLSDVMKQNYALSLQIEYLSKQLQEISDKLDIINVNVLINSTLTEITPAYQRIKYVNEKFEELTFATETSSKVKKDGSPADILDELTELTELAKSVTKNDVDGFEFYLNTFHDVMVGNNLFGRSALKTASELITKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALIGFEISNDSITVLKVYEAKLKQNYQVDKDSLSEVIYGDMDKLLCPDQSEQIYYTNNIVFPNGYVITKIDFTKKMKTLRYEVTANFYDSSTGEIDLNKKKVESSEAEYRTLSANDDGVYMPLGVISETFLTPINGFGLQADENSRLITLTCKSHLRELLLATDLSNKETKLIVPPSGFISNIVENGSIEEDNLEPWKANNKNAYVDHTGGVNGTKALYVHKDGGISQFIGDKLKPKTEYVIQYTVKGKPSIHLKDENTGYIHYEDTNNNLEDYQTINKRFTTGTDLKGVYLILKSQNGDEAWGDNFIILEISPSEKLLSPELINTNNWTSTGSTNISGNTLTLYQGGRGILKQNLQLDSFSTYRVYFSVSGDANVRIRNSREVLFEKRYMSGAKDVSEMFTTKFEKDNFYIELSQGNNLYGGPIVHFYDVSIK

SEQ ID NO: 1496 - protein, 789 aa, Bacillus thuringiensis
MNKNNTKLSTRALPGFIDYFNGIYGFATGIKDIMNMIFKTDTGGDLTLDEILKNQQLLNDISGKLDGVNGSLNDLIAQGNLNTELSKEILKIANEQNQVLNDVNNKLDAINTMLRVYLPKITSMLSDVMKQNYALSLQIEYLSKQLQEISDKLDIINVNVLINSTLTEITPAYQRIKYVNEKFEELAFATETSSKVKKDGSPADILDELTELTELAKSVTKNDVDGFEFYLNTFHDVMVGNNLFGRSALKTASELITKENVKTSGSGVGNVYNFLIVLTALQAKAFLTLTTCRKLLGLADIDYTSIMNEHLNKEKEEFRVNILPTLSNTFSNPNYAKVKGSDEDAKMIVEAKPGHALIGFEISNDSITVLKVYEAKLKQNYQVDKDSLSEVIYGDMDKLLCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGISQFIGDKLKPKTEYVIQYTVKGKPSIHLKDENTGYIHYEDTNNNLEDYQTINKRFTTGTDLKGVYLILKSQNGDEAWGDNFIILEISPSEKLLSPELINTNNWTSTGSTNISGNTLTLYQGGRGILKQNLQLDSFSTYRVYFSVSGDANVRIRNSREVLFEKRYMSGAKDVSEMFTTKFEKDNFYIELSQGNNLYGGPIVHFYDVSIK

SEQ ID NO: 1497 - protein, 789 aa, Vip3Aa24
MNKNNTKLSTRALPSFIDYFNGIYGFATGIKDIMNMIFKTDTGGDLTLDEILKNQQLLNDISGKLDGVNGSLNDLIAQGNLNTKLSKEILKIANEQNQVLNDVNNKLDAINTMLRVYLPKITSMLSDVMKQNYALSLQIKYLSKQLQEISDKLDIINVNVLINSTLTEITPAYQRIKYVNEKFEELTFATETSSKVKKDGSPADILDELTELTELAKSVTKNDVDGFEFYLNTFHDVMVGNNLFGRSALKTASELITKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALIGFEISNDSITVLKVYEAKLKQNYQADKDSLSEVIYGDMDKLLCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGISQFIGDKLKPKTEYVIQYTVKGKPSIHLKDENTGYIHYEDTNNNLEDYQTINKRFTTGTDLKGVYLILKSQNGDEAWGDNFIILEISPSEKLLSPELINTNNWTSTGSTNISGNTLTLYQGGRGILKQNLQLDSFSTYRVYFSVSGDANVRIRNSREVLFEKRYMSGAKDVSEMFTTKFEKDNFYIELSQGNNLYGGPIYHLHDVSIK

SEQ ID NO: 1498 - protein, 789 aa, Bacillus thuringiensis; identical to SEQ ID NO: 1497

SEQ ID NO: 1499 - protein, 789 aa, Bacillus thuringiensis
MNKNNTKLSTRALPSFIDYFNGIYGFATGIKDIMNMIFKTDTGGDLTLDEILKNQQLLNDISGKLDGVNGSLNDLIAQGNLNTELSKEILRIANEQNQVLNDVNNKLDAINTMLRVYLPKITSMLSDVMKQNYALSLQIEYLSKQLQEISDKLDIINVNVLINSTLTEITPAYQRIKYVNEKFEELTFATETSSKVKKDGSPADILDELTELTELAKSVTKNDVDGFEFYLNTFHDVMVGNNLFGRSALKTASELITKENVKTSGSEVGNVYNFLIVLTALQAKAFLTLTTCRKLLGLADIDYTSIMNEHLNKEKEEFRVNILPTLSNTFSNPNYAKVKGSNEDAKMIVEAKPGHALIGFEISNDSITVLKVYEAKLKQNYQVDKDSLSEVIYGDMDKLLCPDQSEQIYYTNNIVFPNEYVITKIDFTKKMKTLRYEVTANFYDSSTGEIDLNKKKVESSEAEYRTLSANDDGVYMPLGVISETFLTPINEFGLQADENSRLITLTCKSYLREPLLATDLSNKETKLIVPPSGFISNIVENGSIEEDNLEPWKANNKNAYVDHTGGVNGTKALYVHKDGGISQFIGDKLKPKTEYVIQYTVKGKPSIRLKDENTGYIHYEDTNNNLEDYQTINKRFTTGADLKGVYLILKSQNGDEAWGDNFIILEISPSEKLLSPELINTNNWTSTGSTNISGNTLTLYQGGRGILKQNLQLDSFSTYRVYFSVSGDANVRIRNSREVLFEKRYMSGAKDVSEMFTTKFEKDNFYTELSQGNNLYGGPIVHFYDVSIK

SEQ ID NO: 1500 - protein, 789 aa, Bacillus thuringiensis
MNKNNTKLSTRALPSFIDYFNGIYGFATGIKDIMNMIFKTDTGGDLTLDEILKNQQLLNDISGKLDGVNGSLNDLIAQGNLNTELSKEILKIANEQNQVLNDVNNKLDAINTMLRVYLPKITSMLSDVMKQNYALSLQIEYLSKQLQEISDKLDIINVNVLINSTLTEITPAYQRIKYVNEKFEELTFATETSSKVKKDGSPADILDELTELTELAKSVTKNGVDGFEFYLNTFHDVMVGNNLFGRSALKTASELITKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALIGFEISNDSITVLKVYEAKLKQNYQVDKDSLSEVIYGDMDELLCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGISQFIGDKLKPKTEYVIQYTVKGKPSIHLKDENTGYIHYEDTNNNLEDYQTINKRFTTGTDLKGVYLILKSQNGDEAWGDNLIILEISPSEKLLSPELINTNNWTSTGSTNISGNTLTLYQGGRGILKQNLQLDSLSTYRVYFSVSGDANVRIRNSREVLFEKRYMSGAKDVSEMFTTKFEKDNFYIELSQGNNLYGGPIVHFYDVSIK

SEQ ID NO: 1501 - protein, 789 aa, Bacillus thuringiensis
MNKNNTKLSTRALPSFIDYFNGIYGFATGIKDIMNMIFKTDTGGDLTLDEILKNQQLLNDISGKLDGVNGSLNDLIAQGNLNTELSKEILKIANEQNQVLNDVNNKLDAINTMLRVYLPKITSMLSDVMKQNYALSLQIEYLSKQLQEISDKLDIINVNVLINSTLTEITPAYQRIKYVNEKFEELTFATETSSKVKKDGSPADILDELTELTELAKSVTKNDVDGFEFYLNTFHDVMVGNNLFGHSALKTASELITKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALIGFEISNDSITVLKVYEAKLKQNYQVDKDSLSEVIYGDMDKLLCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGISQFIGDKLKPKTEYVIQYTVKGKPSIHLKDENTGYIHYEDTNNNLEDYQTINKRFTTGTDLKGVYLILKSQNGDEAWGDNFIILEISPSEKLLSPELINTNNWTSTGSTNISGNTLTLYQGGRGILKQNLQLDSFSTYRVYFSVSGDANVRIRNSREVLFEKRYMSGAKDVSEMFTTKFEKDNFYIELSQGNNLYGGPIVHFYDVSIS

SEQ ID NO: 1502 - protein, 788 aa, Bacillus thuringiensis
MNKNNTKLSNFRCLYLVEYFNGIYGFATGIKDIMNMIFKTDTGGDLTLDEILKNQQLLNDISGKLDGVNGSLNDLIAQGNLNTELSKEILKIANEQNQVLNDVNNKLDAINTMLRVYLPKITSMLSDVMKQNYALSLQIEYLSKQLQEISDKLDIINVNVLINSTLTEITPAYQRIKYVNEKFEELTFATETSSKVKKDGSPADILDELTELTELAKSVTKNDVDGFEFYLNTFHDVMVGNNLFGRSALKTASELITKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALIGFEISNDSITVLKVYEAKLKQNYQVDKDSLSEVIYGDMDKLLCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGISQFIGDKLKPKTEYVIQYTVKGKPSIHLKDENTGYIHYEDTNNNLEDYQTINKRFTTGTDLKGVYLILKSQNGDEAWGDNFIILEISPSEKLLSPELINTNNWTSTGSTNISGNTLTLYQGGRGILKQNLQLDSFSTYRVYFSVSGDANVRIRNSREVLFEKRYMSGAKDVSEMYTPKFEKDNFYIELLKAKNKNKLIALFYDVSIK

SEQ ID NO: 1503 - protein, 787 aa, Bacillus thuringiensis
MNKNNTKLSHVVVISFIDYFNGIYGFATGIKDIMNMIFKTDTGGDLTLDEILKNQQLLNDISGKLDGVNGSLNDLIAQGNLNTELSKEILKIANEQNQVLNDVNNKLDAINTMLRVYLPKITSMLSDVMKQNYALSLQIEYLSKQLQEISDKLDIINVNVLINSTLTEITPAYQRIKYVNEKFEELTFATETSSKVKKDGSPADILDELTELTELAKSVTKNDVDGFEFYLNTFHDVMVGNNLFGRSALKTASELITKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALIGFEISNDSITVLKVYEAKLKQNYQVDKDSLSEVIYGDMDKLLCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGISQFIGDKLKPETEYVIQYTVKGKPSIHLKDENTGYIPYEDTNNNLEDYQTINKRFTTGTDLKGVYLILKSQNGDEAWGDNFIILEISPSEKLLSPELINTNNWTSTGSTNISGNTLTLYQGGRGILKQNLQLDSFSTYRVYFSVSGDANVRIRNSREVLFEKRYMSGAKDVSEMFTTKFEKDNFYIEPLKGITIWVNSPFYDVSIK

SEQ ID NO: 1504 - protein, 788 aa, Bacillus thuringiensis
MNKNNTKLSNVNELSSLSDYFNGIYGFATGIKDIMNMIFKTDTGGDLTLDEILKNQQLLNDISGKLDGVNGSLNDLIAQGNLNTELSKEILKIANEQNQVLNDVNNKLDAINTMLRVYLPKITSMLSDVMKQNYALSLQIEYLSKQLQEISDKLDIINVNVLINSTLTEITPAYQRIKYVNEKFEELTFATETSSKVKKDGSPADILDELTELTELAKSVTKNDVDGFEFYLNTFHDVMVGNNLFGRSALKTASELITKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALIGFEISNDSITVLKVYEAKLKQNYQVDKDSLSEVIYGDMDKLLCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGISQFIGDKLKPKTEYVIQYTVKGKPSIHLKDENTGYIHYEDTNNNLEDYQTINKRFTTGTDLKGVYLILKSQNGDEAWGDNFIILEISPSEKLLSPELINTNNWTSTGSTNISGNTLTLYQGGRGILKQNLQLDSFSTYRVYFSVSGDANVRIRNSREVLFEKRYMSGAKDVSEMFTTKFEKDNFYIELLKGRTRIDLSPFYDVSIK

SEQ ID NO: 1505 - protein, 788 aa, Bacillus thuringiensis
MNKNNTKLSKNELSRLSDYFNGIYGFATGIKDIMNMIFKTDTGGDLTLDEILKNQQLLNDISGKLDGVNGSLNDLIAQGNLNTELSKEILKIANEQNQVLNDVNNKLDAINTMLRVYLPKITSMLSDVMKQNYALSLQIEYLSKQLQEISDKLDIINVNVLINSTLTEITPAYQRIKYVNEKFEELTFATETSSKVKKDGSPADILDELTELTELAKSVTKNDVDGFEFYLNTFHDVMVGNNLFGRSALKTASELITKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALIGFEISNDSITVLKVYEAKLKQNYQVDKDSLSEVIYGDMDKLLCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGISQFIGDKLKPKTEYVIQYTVKGKPSIHLKDENTGYIHYEDTNNNLEDYQTINKRFTTGTDLKGVYLILKSQNGDEAWGDNFIILEISPSEKLLSPELINTNNWTSTGSTNISGNTLTLYQGGRGILKQNLQLDSFSTYRVYFSVSGDANVRIRNSREVLFEKRYMSGAKDVSEMFTTKFEKDNFYIELSQGKNKNRLNGPFYDVSIK

SEQ ID NO: 1506 - protein, 789 aa, Bacillus thuringiensis; identical to SEQ ID NO: 1479

SEQ ID NO: 1507 - protein, 789 aa, Bacillus thuringiensis; identical to SEQ ID NO: 1479

SEQ ID NO: 1508 - protein, 789 aa, Bacillus thuringiensis
MNKNNTKLSTRALPSFIDYFNGIYGFATGIKDIMNMIFKTDTGGDLTLDEILKNQQLLNDISGKLDGVNGSLNDLIAQGNLNTELSKEILKIANEQNQVLNDVNNKLDAINTMLRVYLPKITSMLSDVMKQNYALSLQIEYLSKQLQEISDKLDIINVNVLINSTLTEITPAYQRIKYVNEKFEELTFATETSSKVKKDGSPADILDELTELTELAKSVTKNDVDGFEFYLNTFHDVMVGNNLFGRSALKTASELITKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEISNDSITVLKVYEAKLKQNYQVDKDSLSEVIYGDMDKLLCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFIKNIVENGSIEEDNLEPWKANNKNAYVDHTGGVNGTKALYVHKDGGISQFIGDKLKPKTEYVIQYTVKGKPSIHLKDENTGYIHYEDTNNNLEDYQTITKRFTTGTDLKGVYLILKSQNGDEAWGDNFIILEISPSEKLLSPELINTNNWTSTGSTNISGNTLTLYQGGRGILKQNLQLDSFSTYRVYFSVSGDANVRIRNSREVLFEKRYMSGAKDVSEIFTTKLGKDNFYIELSQGNNLNGGPIVKFSDVSIK

SEQ ID NO: 1509 - protein, 789 aa, Bacillus thuringiensis; identical to SEQ ID NO: 1479

SEQ ID NO: 1510 - protein, 789 aa, Bacillus thuringiensis; identical to SEQ ID NO: 1479

SEQ ID NO: 1511 - protein, 789 aa, Bacillus thuringiensis
MNMNNTKLNARALPSFIDYFNGIYGFATGIKDIMNMIFKTDTGGDLTLDEILKNQQLLNDISGKLDGVNGSLNDLIAQGNLNTELSKEILKIANEQNQVLNDVNNKLDAINTMLRVYLPKITSMLSDVMKQNYALSLQIEYLSKQLQEISDKLDIINVNVLINSTLTEITPAYQRIKYVNEKFEELTFATETSSKVKKDGSPADILDELTELTELAKSVTKNDVDGFEFYLNTFHDVMVGNNLFGRSALKTASELITKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEVSNDSITVLKVYEAKLKQNYQVDKDFLSEVIYGDMDKLLCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGISQFIGDKLKPKTEYVIQYTVKGKPSIHLKDENTGYIHYEDTNNNLEDYQTITKRFTTGTDLKGVYLILKSQNGDEAWGDNFIILEISPSEKLLSPELINTNNWTSTGSTNISGNTLTLYQGGRGILKQNLQLDSFSTYRVYFSVSGDANVRIRNSREVLFEKRYMSGAKDVSEMFTTKFEKDNFYIELSQGNNLYGGPIVHFYDVSIK

SEQ ID NO: 1512 - protein, 789 aa, Bacillus thuringiensis
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDMDKLLCPDQSEQIYYTNNIVFPNEYVITKIDFTKKMKTLRYEVTANSYDSSTGEIDLNKKKVESSEAEYRTLSAKDDGVYMPLGVISETFLTPINGFGLQADENSRLITLTCKSYLRELLLATDLSNKETKLIVPPSGFISNIVENGNLEGENLEPWIANNKNAYVDHTGGVNGTRALYVHKDGGFSQFIGDKLKPKTEYVIQYTVKGKPSIHLKNENTGYIHYEDTNNNLEDYQTITKRFTTGTDLKGVYLILKSQNGDEAWGDNFTILEISPSEKLLSPELINVNNWIRTGSTHISGNTLTLYQGGGGNLKQNLQLDSFSTYRVNFSVTGDANVRIRNSREVLFEKRYMSGAKDVSEIFTTKLGKDNFYIELSQGNNLYGGPLVKFNDVSIK

SEQ ID NO: 1513 - protein, 789 aa, Bacillus thuringiensis
MNKNNTKLSARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDMDKLLCPDQSEQIYYTNNIVFPNEYVITKIDFTKKMKTLRYEVTANSYDSSTGEIDLNKKKVESSEAEYRTLSAKDDGVYMPLGVISETFLTPINGFGLQADENSRLITLTCKSYLRELLLATDLSNKETKLIVPPSGFISNIVENGNLEGENLEPWIANNKNAYVDHTGGVNGTRALYVHKDGGFSQFIGDKLKPKTEYVIQYTVKGKPSIHLKNENTGYIHYEDTNNNLEDYQTITKRFTTGTDLKGVYLILKSQNGDEAWGDNFTILEISPSEKLLSPELINVNNWIRTGSTHISGNTLTLYQGGGGNLKQNLQLDSFSTYRVNFSVTGDANVRIRNSREVLFEKRYMSGAKDVSEIFTTKLGKDNFYIELSQGNNLYGGPLVHFYDVSIK

SEQ ID NO: 1514 - protein, 789 aa, Bacillus thuringiensis
MNMNNTKLSARALPSLIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLLGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDMDKLLCPDQSEQIYYTNNIVFPNEYVITKIDFTKKMKTLRYEVTANSYDSSTGEIDLNKKKVESSEAEYRTLSAKDDGVYMPLGVISETFLTPINGFGLQADENSRLITLTCKSYLRELLLATDLSNKETKLIVPPSGFISNIVENGNLEGENLEPWIANNKNAYVDHTGGVNGTRALYVHKDGGFSQSIGDKLKPKTEYVIQYTVKGKPSIHLKNENTGYIHYEDTNNNLEDYQTITKRFTTGTDLKGVYLILKSQNGDEAWGDNFTILEISPSEKLLSPELINVNNWIRTGSTHISGYTLTLYQGGGGNLKQNLQLDSFSTYRVNFSVTGDANVRIRNSREVLFEKRYMSGAKDVSEIFTTKLGKDNFYIELSQGNNLYGGPLVHFYDVSIK

SEQ ID NO: 1515 - protein, 789 aa, Bacillus thuringiensis
MNKNNTKLSTRALPSFIDYFNGIYGFATGIKDIMNMIFKTDTGGDLTLDEILKNQQLLNDISGKLDGVNGSLNDLIAQGNLNTELSKEILKIANEQNQVLNDVNNKLDAINTMLRVYLPKITSMLSDVMKQNYALSLQIEYLSKQLQEISDKLDIINVNVLINSTLTEITPAYQRIKYVNEKFEELTFATETSSKVKKDGSPADILDELTELTELAKSVTKNDVDGFEFYLNTFHDVMVGNNLFGRSALKTASELITKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEISNDSITVLKVYEAKLKQNYQVDKDSLSEVIYGDMDKLLCPDQSEQIYYTNNIVFPNEYVITKIDFTKKMKTLRYEVTANFYDSSTGEIDLNKKKVESSEAEYRTLSANDDGVYMPLGVISEAFLTPINGFGLQADENSRLITLTCKSYLRELLLATDLSNKETKLIVPPSGFIKNIVENGSIEEDNLEPWKANNKNAYVDHTGGVNGTKALYVHKDGGISQFIGDKLKPKTEYVIQYTVKGKPSIHLKDENTGYIHYEDTNNNLEDYQTITKRFTTGTDLKGVYLILKSQNGDEAWEDNFIILEISPSEKLLSPELINTNNWTSTGSTNISGNTLTLYQGGRGILKQNLQLDSFSTYRVYFSVSGDANVRIRNSREVLFEKRYMSGAKDVSEIFTTKLGKDNFYIELSQGNNLNGGPIVKFSDVSIK

SEQ ID NO: 1516 - protein, 789 aa, Bacillus thuringiensis; identical to SEQ ID NO: 1479

SEQ ID NO: 1517 - protein, 789 aa, Bacillus thuringiensis; identical to SEQ ID NO: 1479

SEQ ID NO: 1518 - protein, 789 aa, Bacillus thuringiensis
MNKNNTKLSTRALPSFIDYFNGIYGFATGIKDIINMIFKTDTGGDLTLDEILKNQQLLNDISGKLDGVNGSLNDLIAQGNLNTELSKEILKIANEQNQVLNDVNNKLDAINTMLRVYLPKITSMLSDVMKQNYALSLQIEYLSKQLQEISDKLDIINVNVLINSTLTEITPAYQRIKYVNEKFEELTFATETSSKVKKDGSPADILDELTELTELAKSVTKNDVDGFEFYLNTFHDVMVGNNLFGRSALKTASELITKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALIGFEISNDSITVLKVYEAKLKQNYQVDKDSLSEVIYGDMDKLLCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGISQFIGDKLKPKTEYVIQYTVKGKPSIHLKDENTGYIHYEDTNNNLEDYQTINKRFTTGTDLKGVYLILKSQNGDEAWGDNFIILEISPSEKLLSPELINTNNWTSTGSTNISGNTLTLYQGGRGILKQNLQLDSFSTYRVYFSVSGDANVRIRNSREVLFEKRYMSGAKDVSEMFTTKFEKDNFYIELSQGNNLYGGPIVHFYDVSIK

SEQ ID NO: 1519 - protein, 789 aa, Bacillus thuringiensis; identical to SEQ ID NO: 1518

SEQ ID NO: 1520 - protein, 788 aa, Bacillus thuringiensis
MNKNNTKLSTRALPSFIDYFNGVYGFATGIKDIMNMIFKTDTGGDLTLDEILKNQQLLNDISGKLDGVNGSLNDLIAQGNLNTELSKEILKIANEQNQVLNDVNNKLDAINTMLRVYPPKITSMLSDVMKQNYALSLQIEYLSKQLQEISDKLDIINVNVLINSTLTEITPAYQRIKYVNEKFEELTFATETSSKVKRDGSPADILDELTELTELAKSVTKNDVDGFEFYLNTFHDVMVGNNLFGRSALKTASELITKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALIGFEISNDSITVLKVYEAKLKQNYQVDKDSLSEVIYGDMDKLLCPDQSEQIYYTNNIVFPNEYVITKIDFTKKMKTLRYEVTANLYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGISQFIGDKLKPKTKYVIQYTVKGKPSIHLKDENTGYIHYEDTNNNLEDYQTINKRFTTGTDLKGVYLILKSQNGDEAWGDNFIILEISPSEKLLSPELINTNNWTSTGSTNISGNTLTLYQGGRGILKQNLQLDSFSTYRVYFSVSGDANVRIRNSREVLFEKRYMSGAKDVSEMFTTKFEKDNFYIELSQGNNLYGGPIVHFYDVSI

SEQ ID NO: 1521 - protein, 788 aa, Bacillus thuringiensis; identical to SEQ ID NO: 1520

SEQ ID NO: 1522 - protein, 788 aa, Bacillus thuringiensis
MNKNNTKLSTRALPSFIDYFNGIYGFATGIKDIMNMIFKTDTGGDLTLDEILKNQQLLNDISGKLDGVNGSLNDLIAQGNLNTELSKEILKIANEQNQVLNDVNNKLDAINTMLRVYLPKITSMLSDVMKQNYALSLQIEYLSKQLQEISDKLDIINVNVLINSTLTEITPAYQRIKYVNEKFEELTFATETSSKVKKDGSPADILDELTELTELAKSVTKNDVDGFEFYLNTFHDVRVGNNLFGRSALKTASELITKENVKTSGSEVGNVYNFLIVLTALQAKAFLTLTTCRKLLGLADIDYTSIMNEHLSKEKEEFRVNILPTLSNTFSNPNYAKVKGSDEDAKMIVEAKPGHALIGFEISNDSITVLKVYEAKLKQNYQVDKDSLSEVIYGDMDKLLCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGISQFIGDKLKPKTEYVTQYTVKGKPSIHLKDENTGYIHYEDTNNNLEDYQTINKRFTTGTDLKGVYLILKSQNGDEAWGDNFIILEISPSEKSLSPELINTNNWTSTGSTNISGNTLTLYQGGRGILKQNLQLDSFSTYRVYFSVSGDANVRIRNSREVLFEKRYMSGAKDVSEMFTTKFEKDNFYIELSQGNNLYGGPIVHFYDVSI

SEQ ID NO: 1523 - protein, 788 aa, Bacillus thuringiensis; identical to SEQ ID NO: 1522

SEQ ID NO: 1524 - protein, 787 aa, Bacillus thuringiensis
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQVEYLSKQLKEISDKLDVINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEISNDSMTVLKVYEAKLKQNYQVDKDSLSEVIYSDMDKLLCPDQSEQIYYTNNIVFPNEYVITKIDFTKKMKTLRYEVTANSYDSSTGEIDLNKKKVESSEAEYRTLSANNDGVYMPLGVISETFLTPINGFGLQADENSRLITLTCKSYLRELLLATDLSNKETKLIVPPISFISNIVENGNLEGENLEPWIANNKNAYVDHTGGINGTKVLYVHKDGEFSQFVGGKLKSKTEYVIQYIVKGKASIYLKDKKNENSIYEEINNDLEGFQTVTKRFITGTDSSGIHLIFTSQNGEGAFGGNFIISEIRTSEELLSPELIMSDAWVGSQGTWISGNSLTINSNVNGTFRQNLPLESYSTYSMNFTVNGFGKVTVRNSREVLFEKSYPQLSPKDISEKFTTAANNTGLYVELSRSTSGGAINFRDFSIK

SEQ ID NO: 1525 - protein, 787 aa, Bacillus thuringiensis; identical to SEQ ID NO: 1524

SEQ ID NO: 1526 - protein, 787 aa, Bacillus thuringiensis; identical to SEQ ID NO: 1524

SEQ ID NO: 1527 - protein, 786 aa, Bacillus thuringiensis
MQKNNKLSVKALPSFIDYFNGIYGFATGIKDIMNMIFKTNTGGDLTLDEILKNQQLLNEISGKLDGVNGSLNDLLAQGNLDTELSKEILKIANEQNKVLNDVNTKLDAINLMLNTYLPKITSMLSDVMKQNYALGLQIEYLSKQLKEISDKLDVINVNVLINSTLTEITPAYQRIKYVNEKFEALTSATETNLKTKQDSSHTDILDELTELTELAKSVTKNDVDGFEFYLNTFHDVMIGNNLFGRSALKTASELIAKENLKTSGSEVGNVYNFLIVLTALQAKAFLTLTTCRKLLGLADIDYTPIMNEHLNKEKEEFRVNILPTLSNTFSNPNYEKARGSDKDAKIIMEAKPGYALVGFEISKDSIAVLKVYQAKLKHNYQIDKDSLSEIVYGDIDKLLCPDQSEQMYYTNKIAFPNEYVITKIAFTKKLNSLRYEVTANFYDSSTGDIDLNKKKIESSEAEFSMLNANNDGVYMPIGTISETFLTPINGFGLVVDENSRLVTLTCKSYLRETLLATDLSNKETKLIVPPNGFISNIVENGNLEGENLEPWKANNKNAYVDHTGGVNGTKVLYVHEDGEFSQFIGDKLKLKTEYVIQYIVKGKAAIYLKDEKNGDYIYEETNNELEDFQAVTKRFITGTDSSRVHLIFTSQNGEEAFGGNFIISEIRPSEELLSPELIKSDAWVGSQGTWISGNSLNINSNVNGTFRQNLSLESYSTYSMNFNVNGFGKVTIRNSREVVFERSYLQFSSKYISEKFTTTTNNTGLYVELSRASSRGVINFGDFSIK

SEQ ID NO: 1528 - protein, 786 aa, Bacillus thuringiensis
MNMNNTKLNARALPSFIDYFNGIYGFATGIKDIMNMIFKTDTGGNLTLDEILKNQQLLNEISGKLDGVNGSLNDLIAQGNLNTELAKQILKVANEQNQVLNDVNNKLDAINSMLKIYLPKITSMLSDVMKQNYVLSLQIEYLSKQLQEISDKLDIINVNVLINSTLTEITPAYQRIKYVNEKFDDLTFATENTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKAKGSNEDTKMIVEAKPGYVLVGFEMSNNSITVLKAYQAKLKKDYQIDKDSLSEIIYSDTDKLLCPDQSEQIYYTKNIAFPNEYVITKIAFTKKMNSLRYEATANFYDSSTGDIDLNKTKVESSEAEYSMLKASDDEVYMPLGLISETFLNPINGFRLAVDENSRLVTLTCRSYLRETLLATDLNNKETKLIVPPNVFISNIVENGNIEMDTLEPWKANNENANVDYSGGVNGTRALYVHKDGEFSHFIGDKLKSKTEYLIRYIVKGKASIFLKDEKNENYIYEDTNNNLEDYQTITKRFTTGTDSTGVYLIFNSQNGDEAWGDNFIILEISPCEKLLSPELIKTDKWISTGSTYISDDRLTLYQGGRGILKQNLQLDRFSTYRVNFSVNGDANVRIRNSREVLLEKRYLNRKGVSEMFTTKFDKDNFYVELSQGDNLGTVVHFYDFSIK

SEQ ID NO: 1529 - protein, 786 aa, Bacillus thuringiensis
MNMNNAKLNARALPSFIDYFNGIYGFATGIKDIMNMIFKTDTGSNLTLDEILKNQQLLNEISGKLDGVNGSLNDLIAQGNLNTELAKQILKVANEQNQVLNDVNNKLDAINSMLKIYLPKITSMLSDVMKQNYVLSLQIEYLSKQLQEISDKLDIINVNVLINSTLTEITPAYQRMKYVNEKFEELTFATETTLKVKKDSPPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKAKGSNEDTKMIVEAKPGYVLVGFEMSNDSITVLKAYQAKLKKDYQIDKDSLSEIIYSDTDKLLCPDQSEQIYYTKNIAFPNEYVITKIAFTKKMNSLRYEATANFYDSSTGDIDLNKTKVESSEAEYSMLKASDDEVYMPLGLISETFLNPINGFRLAVDENSRLVTLTCRSYLRETLLATDLNNKETKLIVPPNVFISNIVENGNIEMDTLEPWKANNENANVDYSGGVNGTRALYVHKDGEFSHFIGDKLKSKTEYLIRYIVKGKASIFLKDEKNENYIYEDTNNNLEDYQTITKRFTTGTDSTGVYLIFNSQNGDEAWGDNFIILEISPCEKLLSPELIKTDKWNSTGSTYISDDRLTLYRGGRGILKQNLQLDGFSTYRVNFSVDGDANVRIRNSREVLLEKRYLNRKGVSEMFTTKFDKDNFYVELSQGDNLGTIVHFYDFSIK

SEQ ID NO: 1530 - protein, 787 aa, Bacillus thuringiensis
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKEDGSPADILDELTELTELAKSVTKNEVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYVKAKGSDRDAKMIVEAKPGYALVGFEMSNDSMTVLKAYQAKLKQDYQVDKDSLSEIVYGDMNKLLCPDQSEQIYYTNNIAFPREYVITKLTFTKKMNSLRYEATANFYDSSTGDMDLNKTKVESSEAEYSRLSASNDGVYMPLGLISETFLTPINGFGLVVDENSRLVTLTCKSYLREILLATDLSNKETKLIVPPNGFISNIVENGNLEGENLEPWKANNKNAYIDHTGGVKGTKVLYVHKDGEFSQFIGYKLKSKTEYVIQYIVKGKAVIYLKDEKNGDYIYEEINNELEDFQTVTKRFITGTDSSGVHLIFTSQNGEEAFGGNFIISEIRPSEELLSPELIKSDAWVGTQGAWNSGNSLTIYTNTNGTFRQNLPLESYSTYSMNFNITGFGKVTIRNSREVLFEKNFSQLSPKDYSEKFTTAANNTGFYVELSRGTQGGNITFRDFSIK

SEQ ID NO: 1531 - protein, 788 aa, Bacillus thuringiensis
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSREVLFERSNLMSSTSHISGTFKTESNNTGLYVELSRRSGGGGHISFENVSIK

SEQ ID NO: 1532 - protein, 787 aa, Bacillus thuringiensis
MNKNNTKLSTRALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLAGIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSRVLFERSNLMSSTSHISGTFKTESNNTGLYVELSRRSGGGGHISFENVSIK

SEQ ID NO: 1533 - protein, 788 aa, Bacillus thuringiensis
MNKNNTKLSTRALPSFIDYFNGIYGFATGIKDIMNMIFKTDTGGDLTLDEILKNQQLLNDISGKLDGVNGSLNDLIAQGNLNTELSKEILKIANEQNQVLNDVNNKLDAINTMLRVYLPKITSMLSDVMKQNYALSLQIEYLSKQLQEISDKLDIINVNVLINSTLTEITPAYQRIKYVNEKFEELTFATETSSKVKKDGSPADILDELTELTELAKSVTKNDVDGFEFYLNTFHDVMVGNNLFGRSALKTASELITKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALIGFEISNDSITVLKVYEAKLKQNYQVDKDSLSEVIYGDMDKLLCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGISQFIGDKLKPKTEYVIQYTVKGKPSIHLKDENTGYIHYEDTNNNLEDYQTINKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSRGVLFERSNLMSSTSHISGTFKTESNNTGLYVELSRRSGGGGHISFENVSIK

SEQ ID NO: 1534 - protein, 788 aa, Bacillus thuringiensis; identical to SEQ ID NO: 1531

SEQ ID NO: 1535 - protein, 787 aa, Bacillus thuringiensis
MNKNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLNAINTMLHIYLPKITSMLNDVMKQNYALSLQIEYLSKQLQEISDKLDVINVNVLINSTLTEITPAYQRMKYVNEKFEDLTFATETTLKVKKNSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTFIMNEHLDKEKEEFRVNILPTLSNTFSNPNYAKAKGSNEDAKIIVEAKPGYALVGFEMSNDSITVLKAYQAKLKQDYQVDKDSLSEIVYGDMDKLLCPDQSEQIYYTNNIAFPNEYVITKITFTKKMNSLRYEATANFYDSSTGDIDLNKTKVESSEAEYSTLSASTDGVYMPLGIISETFLTPINGFGIVVDENSKLVNLTCKSYLREVLLATDLSNKETKLIVPPIGFISNIVENGNLEGENLEPWKANNKNAYVDHTGGVNGTKALYVHKDGEFSQFIGDKLKSKTEYVIQYIVKGKASILLKDEKNGDCIYEDTNNGLEDFQTITKSFITGTDSSGVHLIFNSQNGDEAFGENFTISEIRLSEDLLSPELINSDAWVGSQGTWISGNSLTINSNVNGTFRQNLSLESYSTYSMNFNVNGFAKVTVRNSREVLFEKNYPQLSPKDISEKFTTAANNTGLYVELSRFTSGGAINFRNFSIK

SEQ ID NO: 1536 - protein, 787 aa, Bacillus thuringiensis
MNKNNTKLSARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLNAINTMLHIYLPKITSMLNDVMKQNYALSLQIEYLSKQLQEISDKLDVINVNVLINSTLTEITPAYQRMKYVNEKFEDLTFATETTLKVKKNSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTFIMNEHLDKEKEEFRVNILPTLSNTFSNPNYAKAKGSNEDAKIIVEAKPGYALVGFEMSNDSITVLKAYQAKLKRDYQVDKDSLSEIVYGDMDKLLCPDQSEQIYYTNNIAFPNEYVITKITFTKKMNSLRYEATANFYDSSTGDIDLNKTKVESSEAEYSTLSASTDGVYTPLGIISETFLTPINGFGIVVDENSKLVNLTCKSYLREVLLATDLSNKETKLIVPPIGFISNIVENGNLEGENLEPWKANNKNAYVDHTGGVNGTKALYVHKDGEFSQFIGDKLKSKTEYVIQYIVKGKASILLKDEKNGDCIYEDTNNGLEDFQTITKSFITGTDSSGVHLIFNSQNGDEAFGENFTISEIRLSEDLLSPELINSDAWVGSQGTWISGNSLTINSNVNGTFRQNLSLESYSTYSMNFNVNGFAKVTVRNPREVLFEKNYPQLSPKDISEKFTTAANNTGLYVELSRFTSGGAINFRDFSIK

SEQ ID NO: 1537 - protein, 840 aa, Bacillus thuringiensis
  SITE 58: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
MNMNNTKLNARALPSFIDYFNGIYGFATGIKDIMNMIFKTDTGGNLTLDEILKNQQLXNEISGKLDGVNGSLNDLIAQGNLNTELSKEILKIANEQNQVLNDVNNKLNAINTMLHIYLPKITSMLNDVMKQNYALSLQIEYLSKQLQEISDKLDVINVNVLINSTLTEITPAYQRMKYVNEKFEDLTFATETTLKVKKNSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTFIMNEHLDKEKEEFRVNILPTLSNTFSNPNYAKAKGSNEDAKIIVEAKPGYALVGFEMSNDSITVLKAYQAKLKQDYQVDKDSLSEIVYGDMDKLLCPDQSEQIYYTNNIAFPNEYVITKITFTKKMNSLRYEATANFYDSSTGDIDLNKTKVESSEAEYSTLSASTDGVYMPLGIISETFLTPINGFGIVVDENSKLVNLTCKSYLREVLLATDLSNKETKLIVPPIGFISNIVENGNLEGENLEPWKANNKNAYVDHTGGVNGTKALYVHKDGEFSQFIGDKLKSKTEYVIQYIVKGKASILLKDEKNGDCIYEDTNNGLEDFQTITKSFITGTDSSGVHLIFNSQNGDEAFGENFTISEIRLSEDLLSPELINSDAWVGSQGTWISGNSLTINSNVNGTFRQNLSLESYSTYSMNFNVNGFAKVTVRNSREVLFEKNYPQLSPKDISEKFTTAANNTGLYVELSRFTSGGAINFRDFSIKLVDPNSVQARLQDVDGTIDTRSKLAAAQLYTRASQPELAPEDPEDLEHHHHHH

SEQ ID NO: 1538 - protein, 787 aa, Bacillus thuringiensis; identical to SEQ ID NO: 1535

SEQ ID NO: 1539 - protein, 787 aa, Bacillus thuringiensis
MNKNNTKLSARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLNAINTMLHIYLPKITSMLNDVMKQNYALSLQIEYLSKQLQEISDKLDVINVNVLINSTLTEITPAYQRMKYVNEKFEDLTFATETTLKVKKNSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTFIMNEHLDKEKEEFRVNILPTLSNTFSNPNYAKAKGSNEDAKIIVEAKPGYALVGFEMSNDSITVLKAYQAKLKQDYQVDKDSLSEIVYGDMDKLLCPDQSEQIYYTNNIAFPNEYVITKITFTKKMNSLRYEATANFYDSSTGDIDLNKTKVESSEAEYSTLSASTDGVYMPLGIISETFLTPINGFGIVVDENSKLVNLTCKSYLREVLLATDLSNKETKLIVPPIGFISNIVENGNLEGENLEPWKANNKNAYVDHTGGVNGTKALYVHKDGEFSQFIGDKLKSKTEYVIQYIVKGKASILLKDEKNGDCIYEDTNNGLEDFQTITKSFITGTDSSGVHLIFNSQNGDEAFGENFTISEIRLSEDLLSPELINSDAWVGSQGTWISGNSLTINSNVNGTFRQNLSLESYSTYSMNFNVNGFAKVTVRNSREVLFEKNYPQLSPKDISEKFTTAANNTGLYVELSRFTSGGAINFRDFSIK

SEQ ID NO: 1540 - protein, 795 aa, Bacillus thuringiensis
MNKNNTKLSTRALPSFIDYFNGIYGFATGIKDIMNMIFKTDTGGDLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETNLKVKKDGSPADILDELTELTELAKSVTKNDVDGFEFYLNTFHDVMVGNNLFGRSALKTASELITKENVKTSGSEVGNVYNFLIVLTALQAKAFLTLTTCRKLLGLADIDYTSIMNEHLNKEKEEFRVNILPTLSNTFSNPNYIKTKGSDEDAEVIIQAEPGHALVGFEMINDPSPALKVYQAKLKPNYQVDKQSLSETVYGDMDKILCPDKSQQMYYLHNITFPNEYVITEIIFTKKKNSLRYEVIANYYEFSSGDIDLNKKLVKSSEAEYSTLSVSNDAIYMPLGVISETFLTPIKGFGLTVDESSRLVTLTCKSYLREILLATDLSNKATKLIVPPNGFISNLVENGDIEADNIEPWKGNNKNAYVDHTGGVNGTKALYTQDDGEFSQFIGDKLKSKTEYIIQYTVKGNTSIYLKDKKNENVIYEDKNNNLEAFQTITKRFTTELDSSDVYLVFKCKNGYKAWGDNFLITEIRPKEVVSPELIKVENWIGMGGSNHVNPDSLLLFTGGRSILKQNLQLDSYSTYRVRFSLMVIGKAKVIIRNSSEVLFEKSYVNDSEGVLEGVSETFTTKSIQDNFYVELSNEGTFGSKDVAYFYNFSIK

SEQ ID NO: 1541 - protein, 795 aa, Bacillus thuringiensis; identical to SEQ ID NO: 1540

SEQ ID NO: 1542 - protein, 803 aa, Bacillus thuringiensis
MNMNNTKLNARALPSFIDYFNGIYGFATGIKDIMNMIFKTDTGGGNLTLDEILKNQDLLNQISDKLDGINGDLGDLIAQGNLNSELTKELLKIANEQNLMLNNVNAQLNSINATLNTYLPKITSMLNEVMKQNYVLSLQIEFLSKQLQEISDKLDIINLNVLINSTLTEITPAYQRIKYVNDKFDELTSTVEKNPKINQDNFTEDVIDNLTDLTELARSVTRNDMDSFEFYIKTFHDVMIGNNLFSRSALKTASELIAKENIHTRGSEIGNVYTFMIVLTSLQAKAFLTLTTCRKLLGLADIDYTQIMNENLDREKEEFRLNILPTLSNDFSNPNYTETLGSDLVDPIVTLEAEPGYALIGFEILNDPLPVLKVYQAKLKPNYQVDKESIMENIYGNIHKLLCPKQREQKYYIKDMTFPEGYVITKIVFEKKLNLLGYEVTANLYDPFTGSIDLNKTILESWKEDCCEEDCCEEDCCEEDCCEELYKIIEADTNGVYMPLGVISETFLTPIYSFKLIIDEKTKKISLAGKSYLRESLLATDLVNKETNLIPSPNGFISSIVQNWHITSDNIEPWKANNKNAYVDKTDAMVGFSSLYTHKDGEFLQFIGAKLKAKTEYIIQYTVKGNPEVYLKNNKDICYEDKTNNFDTFQTITKKFNSGVDPSEIYLVFKNQIGYEAWGNNFIILEIKSLETLPQILKPENWIPLGNAEIKEDGKIEISGNGSMNQYIQLEQNSKYHLRFSVKGKGRVTMQAQTSHINVPATNEEVSIMIETTRLYGEGIISLLNDEVENSGVIFSDVSIVKE

SEQ ID NO: 1543 - protein, 803 aa, Bacillus thuringiensis; identical to SEQ ID NO: 1542

SEQ ID NO: 1544 - protein, 801 aa, Bacillus thuringiensis
MNNTKLNARALPSFIDYFNGIYGFATGIKDIMNMIFKTDTGGGNLTLDEILKNQDLLNQISDKLDGINGDLGDLIAQGNLNSELTKELLKIANEQNLMLNNVNAQLNSINSTLNTYLPKITSMLSEVMKQNYVLSLQIEFLSEQLQEISDKLDVINLNVLINSTLTEITPAYQRIKYVNDKFDELTSTVEKNPKINQDNFTEDVIDNLTDLTELARSVTRNDMDSFEFYIKTFHDVMIGNNLFSRSALKTASELIAKENIHTMGSEIGNVYTFMVVLTSLQAKAFLTLTACRKLLGLTDIDYTQIMNENLNREKEEFRLNILPTLSNDFSNPNYTETLGSDLVDPIVTLEADPGYALIGFEILNDPLPVLKVYQAKLKPNYQVDKESIMENIYGNIHKLLCPKQRHQKYYIKDITFPEGYVITKIVFEKKLNLLGYEVTANLYDPFTGSIDLNKTILESWKEECCEEECCEEECCEEECCEELYKIIEADTNGVYMPLGVISETFLTPIYSFKLIIDERTKRISLAGKSYLRESLLATDLVNKDTNLIPSPNGFINSIVENWNITSDNIEPWKANNKNAYVDKTDDMVGFNSLYTHKDGEFLQFIGAKLKAKTEYIIQYTVKGSPEVYLKNNKGIFYEDTTNKFDTFQTITKKFNSGVDPSEIYLVFKNQIGYEAWGNKFIILEIKSFETLPQILKPENWMPFGNAEIKEDGKIEISGNGTMTQNIQLEQNSKYHLRFSVKGKGRVAIQTQSSHINVPATNEEVSTMITTRNLYGEGMIYLFNDDVENSKVIFSDVSLVKE

SEQ ID NO: 1545 - protein, 801 aa, Bacillus thuringiensis; identical to SEQ ID NO: 1544

SEQ ID NO: 1546 - protein, 700 aa, Bacillus thuringiensis
MNNTKLNARALPSFIDYFNGIYGFATGIKDIMNMIFKTDTGGGNLTLDEILKNQDLLNQISDKLDGINGDLGDLIAQGNLNSELTKELLKIANEQNLMLNNVNAQLNSINSTLNTYLPKITSMLSEVMKQNYVLSLQIEFLSEQLQEISDKLDVINLNVLINSTLTEITPAYQRIKYVNDKFDELTSTVEKNPKINQDNFTEDVIDNLTDLTELARSVTRNDMDSFEFYIKTFHDVMIGNNLFSRSALKTASELIAKENIHTMGSEIGNVYTFMVVLTSLQAKAFLTLTACRKLLGLTDIDYTQIMNENLNREKEEFRLNILPTLSNDFSNPNYTETLGSDLVDPIVTLEADPGYALIGFEILNDPLPVLKVYQAKLKPNYQVDKESIMENIYGNIHKLLCPKQRQQKYYIKDITFPEGYVITKIVFEKKLNLLGYEVTANLYDPFTGSIDLNKTILESWKEECCEEECCEEECCEEECCEELYKIIEADTNGVYMPLGVISETFLTPIYSFKLIIDERTKRISLAGKSYLRESLLATDLVNKDTNLIPSPNGFISSIVENWNITSDNIEPWKANNKNAYVDKTDDMVGFNSLYTHKDGEFLQFIGAKLKAKTEYIIQYTVKGSPEVYLKNNKGIFYEDTTNKFDTFQTITKKFNSGVDPSEIYLVFKNQIGYEAWGNKFIILEIKSFETLPQILKPENW

SEQ ID NO: 1547 - protein, 490 aa, Bacillus thuringiensis
MNKNNTKLSARALPSFIDYFNGIYGFATGIKDIMNMIFKTDTGGGNLTLDEILKNQDLLNQISDKLDGINGDLGDLIAQGNLNSELIKELLKIANEQNLMLNNVNAQLNSINSTLNTYLPKITSMLSEVMKQNYVLSLQIEFLSEQLQEISDKLDVINLNVLINSTLTEITPAYQRIKYVNDKFDELTSTVEKNPKINQDNFTEDVIDNLTDLTELARSVTRNDMDSFEFYIKTFHDAMIGNNLFSRSALKTASELIAKENIHTMGSEIGNVYTFMVVLTSLQAKAFLTLTACRKLLGLTDIDYTQIMNENLNREKEEFRLNVLPTLSNDFSNPNYTETLGSDLVDPIVTLEADPGYALIGFEILNDPLPVLKVYQAKLKPNYQVDKESIMENIYGNIHKLLCPKQRQQKYYIKDITFPEGYVITKIVFEKKLNLLGYEVTANLYDPFTGSIDLNKTILESWKEECCEEECCEEECCEEECCEELYKIIE

SEQ ID NO: 1548 - protein, 803 aa, Bacillus thuringiensis
MNKNNTKLNARALPSFIDYFNGIYGFATGIKDIMNMIFKTDTGGDLTLDEILKNQQLLNEISGKLDGVNGSLNDLIAQGNLNTELSKEILKIANEQNQVLNDVNNKLDAINTMLNIYLPKITSMLSDVMKQNYALSLQIEYLSRQLQEISDKLDVINLNVLINSTLTEITPSYQRIKYVNEKFDKLTFATESTLRAKQGIFNEDSFDNNTLENLTDLAELAKSITKNDVDSFEFYLHTFHDVLIGNNLFGRSALKTASELITKDEIKTSGSEIGKVYSFLIVLTSLQAKAFLTLTTCRKLLGLSDIDYTSIMNEHLNNEKNEFRDNILPALSNKFSNPSYAKTIGSDNYAKVILESEPGYALVGFEIINDPIPVLKAYKAKLKQNYQVDNQSLSEIVYLDIDKLFCPENSEQKYYTKNLTFPDGYVITKITFEKKLNNLIYEATANFYDPSTGDIDLNKKQVESTFPQTDYITMDIGDDDGIYMPLGVISETFLTPINSFGLEVDAKSKTLTLKCKSYLREYLLESDLKNKETGLIAPPNVFISNVVKNWDIEEDSLEPWVANNKNAYVDNTGGIERSKALFTQGDGEFSQFIGDKLKPNTDYIIQYTVKGKPAIYLKNKSTGYITYEDTNGNSEEFQTIAVKFTSETDLSQTHLVFKSQNGYEAWGDNFIILEAKLFETPESPELIKFNDWERFGTTYITGNELRIDHSRGGYFRQSLNIDSYSTYDLSFSFSGLWAKVIVKNSRGVVLFEKVKNNGSSYEDISESFTTASNKDGFFIELTAERTSSTFHSFRDISIKEKIE

SEQ ID NO: 1549 - protein, 803 aa, Bacillus thuringiensis
MNMNNTKLNARALPSFIDYFNGIYGFATGIKDIMNMIFKTDTGGDLTLDEILKNQQLLNEISGKLDGVNGSLNDLIAQGNLNTELSKEILKIANEQNQVLNDVNNKLDAINTMLNIYLPKITSMLSDVMKQNYALSLQIEYLSRQLQEISDKLDVINLNVLINSTLTEITPSYQRIKYVNEKFDKLTFATESTLRAKQGIFNEDSFDNNTLENLTDLAELAKSITKNDVDSFEFYLHTFHDVLIGNNLFGRSALKTASELITKDEIKTSGSEIGKVYSFLIVLTSLQAKAFLTLTTCRKLLGLSDIDYTSIMNEHLNNEKNEFRDNILPALSNKFSNPSYAKTIGSDNYAKVILESEPGYALVGFEIINDPIPVLKAYKAKLKQNYQVDNQSLSEIVYLDIDKLFCPENSEQKYYTKNLTFPDGYVITKITFEKKLNNLIYEATANFYDPSTGDIDLNKKQVESTFPQTDYITMDIGDDDGIYMPLGVISETFLTPINSFGLEVDAKSKTLTLKCKSYLREYLLESDLKNKETGLIAPPNVFISNVVKNWDIEEDSLEPWVANNKNAYVDNTGGIERSKALFTQGDGEFSQFIGDKLKPNTDYIIQYTVKGKPAIYLKNKSTGYITYEDTNGNSEEFQTIAVKFTSETDLSQTHLVFKSQNGYEAWGDNFIILEAKLFETPESPELIKFNDWERFGTTYITGNELRIDHSRGGYFRQSLNIDSYSTYDLSFSFSGLWAKVIVKNSRGVVLFEKVKNNGSSYEDISESFTTASNKDGFFIELTAERTSSTFHSFRDISIKEKIE

SEQ ID NO: 1550 - protein, 803 aa, Bacillus thuringiensis
MNKNNTKLNARALPSFIDYFNGIYGFATGIKDIMNMIFKTDTGGDLTLDEILKNQQLLNEISGKLDGVNGSLNDLIAQGNLNTELSKEILKIANEQNQVLNDVNNKLDAINTMLNIYLPKITSMLSDVMKQNYALSLQIEYLSRQLQEISDKLDVINLNVLINSTLTEITPSYQRIKYVNEKFDKLTFATESTLRAKQGIFNEDSFDNNTLENLADLAELAKSITKNDVDSFEFYLHTFHDVLIGNNLFGRSALKTASELITKDEIKTSGSEIGKVYSFLIVLTSLQAKAFLTLTTCRKLLGLSDIDYTSIMNEHLNNEKNEFRDNILPALSNKFSNPSYAKTIGSDNYAKVILESEPGYALVGFEIINDPIPVLKAYKAKLKQNYQVDNQSLSEIVYLDIDKLFCPENSEQKYYTKNLTFPDGYVITKITFEKKLNNLIYEATANFYDPSTGDIDLNKKQVESTFPQTDYITMDIGDDDGIYMPLGVISETFLTPINSFGLEVDAKSKTLTLKCKSYLREYLLESDLKNKETGLIAPPNVFISNVVKNWDIEEDSLEPWVANNKNAYVDNTGGIERSKALFTQGDGEFSQFIGDKLKPNTDYIIQYTVKGKPAIYLKNKSTGYITYEDTNGNSEEFQTIAVKFTSETDLSQTHLVFKSQNGYEAWGDNFIILEAKLFETPESPELIKFNDWERFGTTYITGNELRIDHSRGGYFRQSLNIDSYSTYDLSFSFSGLWAKVIVKNSRGVVLFEKVKNNGSSYEDISESFTTASNKDGFFIELTAERTSSTFHSFRDISIKEKIE

SEQ ID NO: 1551 - protein, 803 aa, Bacillus thuringiensis; identical to SEQ ID NO: 1549

SEQ ID NO: 1552 - protein, 803 aa, Bacillus thuringiensis; identical to SEQ ID NO: 1550

SEQ ID NO: 1553 - protein, 60 aa, Hadronyche versuta
MNTATGFIVLLVLATILGGIEAGESHMRKDAMGRVRRQYCVPVDQPCSLNTQPCCDDATC

SEQ ID NO: 1554 - protein, 76 aa, Hadronyche versuta; identical to SEQ ID NO: 569

SEQ ID NO: 1555 - protein, 75 aa, Hadronyche versuta; identical to SEQ ID NO: 572

SEQ ID NO: 1556 - protein, 38 aa, Hadronyche versuta; identical to SEQ ID NO: 573

SEQ ID NO: 1557 - protein, 75 aa, Hadronyche versuta; identical to SEQ ID NO: 574

SEQ ID NO: 1558 - protein, 38 aa, Hadronyche versuta; identical to SEQ ID NO: 575

SEQ ID NO: 1559 - protein, 76 aa, Hadronyche versuta; identical to SEQ ID NO: 576

SEQ ID NO: 1560 - protein, 76 aa, Hadronyche versuta; identical to SEQ ID NO: 578

SEQ ID NO: 1561 - protein, 39 aa, Hadronyche versuta; identical to SEQ ID NO: 6

SEQ ID NO: 1562 - protein, 76 aa, Hadronyche versuta; identical to SEQ ID NO: 580

SEQ ID NO: 1563 - protein, 39 aa, Hadronyche versuta; identical to SEQ ID NO: 581

SEQ ID NO: 1564 - protein, 76 aa, Hadronyche versuta; identical to SEQ ID NO: 582

SEQ ID NO: 1565 - protein, 39 aa, Hadronyche versuta; identical to SEQ ID NO: 581

SEQ ID NO: 1566 - protein, 76 aa, Hadronyche versuta; identical to SEQ ID NO: 584

SEQ ID NO: 1567 - protein, 39 aa, Hadronyche versuta; identical to SEQ ID NO: 581

SEQ ID NO: 1568 - protein, 76 aa, Atrax robustus; identical to SEQ ID NO: 586

SEQ ID NO: 1569 - protein, 39 aa, Atrax robustus; identical to SEQ ID NO: 581

SEQ ID NO: 1570 - protein, 22 aa, Hadronyche versuta
  SITE 4: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
  SITE 10: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
  SITE 16: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
  SITE 20: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
MNTXTGFIVXLVLATXLGGXEA

SEQ ID NO: 1571 - protein, 41 aa, Hadronyche versuta; identical to SEQ ID NO: 5

SEQ ID NO: 1572 - protein, 39 aa, Hadronyche versuta; identical to SEQ ID NO: 12

SEQ ID NO: 1573 - protein, 76 aa, Hadronyche versuta; identical to SEQ ID NO: 569

SEQ ID NO: 1574 - protein, 39 aa, Hadronyche versuta; identical to SEQ ID NO: 571

SEQ ID NO: 1575 - protein, 75 aa, Hadronyche versuta; identical to SEQ ID NO: 572

SEQ ID NO: 1576 - protein, 38 aa, Hadronyche versuta; identical to SEQ ID NO: 573

SEQ ID NO: 1577 - protein, 75 aa, Hadronyche versuta; identical to SEQ ID NO: 574

SEQ ID NO: 1578 - protein, 38 aa, Hadronyche versuta; identical to SEQ ID NO: 575

SEQ ID NO: 1579 - protein, 76 aa, Hadronyche versuta; identical to SEQ ID NO: 576

SEQ ID NO: 1580 - protein, 39 aa, Hadronyche versuta; identical to SEQ ID NO: 12

SEQ ID NO: 1581 - protein, 76 aa, Hadronyche versuta; identical to SEQ ID NO: 578

SEQ ID NO: 1582 - protein, 39 aa, Hadronyche versuta; identical to SEQ ID NO: 6

SEQ ID NO: 1583 - protein, 76 aa, Hadronyche versuta; identical to SEQ ID NO: 580

SEQ ID NO: 1584 - protein, 39 aa, Hadronyche versuta; identical to SEQ ID NO: 581

SEQ ID NO: 1585 - protein, 76 aa, Hadronyche versuta; identical to SEQ ID NO: 582

SEQ ID NO: 1586 - protein, 39 aa, Hadronyche versuta; identical to SEQ ID NO: 581

SEQ ID NO: 1587 - protein, 76 aa, Hadronyche versuta; identical to SEQ ID NO: 584

SEQ ID NO: 1588 - protein, 39 aa, Hadronyche versuta; identical to SEQ ID NO: 581

SEQ ID NO: 1589 - protein, 39 aa, Atrax robustus; identical to SEQ ID NO: 581

SEQ ID NO: 1590 - protein, 39 aa, Atrax robustus; identical to SEQ ID NO: 581

SEQ ID NO: 1591 - protein, 22 aa, Hadronyche versuta
  SITE 4: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
  SITE 10: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
  SITE 16: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
  SITE 20: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
MNTXTGFIVXLVLATXLGGXEA

SEQ ID NO: 1592 - protein, 15 aa, Hadronyche versuta
  SITE 1: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
XESHMRKDAMGRVRR

SEQ ID NO: 1593 - protein, 15 aa, Hadronyche versuta
  SITE 1: note = MISC_FEATURE - Xaa is Ala Arg Asn Asp Asx Cys Glu Gln Glx Gly His Ile Leu LysMet Phe Pro Ser Thr Trp Tyr Val.
  SITE 1: note = MISC_FEATURE - Xaa is Ala, Arg, Asn, Asp, Asx, Cys, Glu, Gln, Glx, Gly, His,Ile, Leu, Lys, Met, Phe, Pro, Ser, Thr, Trp, Tyr, or Val.
XESHMRKDAMGRVRR

The invention claimed is:

1. A combination comprising a Bt toxin selected from the group consisting of: Cry1a, Cry1b, Cry1c, Cry2a, and combinations thereof, and a U+2-ACTX-Hv1a peptide having the amino acid sequence set forth in SEQ ID NO: 5, wherein the Bt toxin and the U+2-ACTX-Hv1a peptide are not fused together as a single fusion protein, wherein the combination is formulated in separate compositions, and wherein the separate compositions of the combination come together and have insecticidal activity.

2. The combination of claim 1, wherein the separate compositions are formulated as powders, dusts, pellets, granules, sprays, emulsions, colloids, solutions, or combinations thereof.

3. The combination of claim 1, wherein the separate compositions are formulated using the same excipients or different excipients.

4. The combination of claim 1, wherein the separate compositions are formulated using the same excipients or different excipients.

5. The combination of claim 1, wherein the combination comprises the Bt toxin integrally expressed in a plant, and the U+2-ACTX-Hv1a peptide is formulated as a composition comprising at least one excipient.

6. The combination of claim 1, wherein the combination comprises the U+2-ACTX-Hv1a peptide integrally expressed in a plant, and the Bt toxin is formulated as a composition comprising at least one excipient.

7. The combination of claim 1, wherein the combination comprises the U+2-ACTX-Hv1a peptide, and the Bt toxin both integrally expressed in a plant.

8. The combination of claim 1, wherein Btk toxin is a *Bacillus thuringiensis* ssp. kurstaki strain EVB-113-19 Btk toxin.

9. The combination of claim 1, wherein the ratio of the Bt toxin to the U+2-ACTX-Hv1a peptide is about 10,000:1, 5,000:1, 1,000:1, 500:1, 250:1, 200:1, 100:1, 99:1, 95:5, 90:10, 85:15, 80:20, 75:25, 70:30, 65:35, 60:40, 55:45, 1:1, 45:55, 40:60, 35:65, 30:70, 25:75, 20:80, 15:85, 10:90, 5:95, 1:99, 1:100, 1:200, 1:250, 1:500, 1:1,000, 1:5,000, or 1:10,000.

10. The combination of claim 9, wherein the ratio of Bt toxin to U+2-ACTX-Hv1a peptide is from about 1:1 to about 1:5000.

11. The combination of claim 10, wherein the ratio of Bt toxin to U+2-ACTX-Hv1a peptide is about 1:4000.

12. The combination of claim 9, wherein the ratio of Bt toxin to U+2-ACTX-Hv1a peptide is from about 1:1 to about 1:10.

13. The combination of claim 12, wherein the ratio of Bt toxin to U+2-ACTX-Hv1a peptide is about 1:9.2.

14. The combination of claim 12, wherein the ratio of Bt toxin to U+2-ACTX-Hv1a peptide is about 1:8.75.

15. A method of using the combination of claim 1 to control insects comprising, providing a combination of a Bt toxin selected from the group consisting of: Crv1a, Cry1b, Crv1c, Cry2a, and combinations thereof, and a U+2-ACTX-Hv1a peptide having the amino acid sequence set forth in SEQ ID NO:5; wherein the Bt toxin is not fused to the U+2-ACTX-Hv1a peptide CRIP; wherein the combination is formulated in separate compositions and then applying said combination to the locus of an insect, and wherein the separate compositions of the combination come together and have insecticidal activity.

16. The method of claim 15, wherein the separate compositions are formulated as powders, dusts, pellets, granules, sprays, emulsions, colloids, solutions, or combinations thereof.

17. The method of claim 15, wherein the separate compositions are formulated using the same excipients or different excipients.

18. The method of claim 15, wherein the combination comprises the Bt toxin integrally expressed in a plant, and the U+2-ACTX-Hv1a peptide is formulated as a composition comprising at least one excipient.

19. The method of claim 15, wherein the combination comprises the U+2-ACTX-Hv1a peptide integrally expressed in a plant, and the Bt toxin is formulated as a composition comprising at least one excipient.

20. The method of claim 15, wherein the combination comprises the U+2-ACTX-Hv1a peptide, and the Bt toxin both integrally expressed in a plant.

21. The method of claim 15, wherein the insects are selected from the group consisting of: Achema Sphinx Moth (Hornworm) (*Eumorpha achemon*); Alfalfa Caterpillar (*Colias eurytheme*); Almond Moth (*Caudra cautella*); Amorbia Moth (*Amorbia humerosana*); Armyworm (*Spodoptera* spp., e.g. exigua, frugiperda, littoralis, *Pseudaletia unipuncta*); Artichoke Plume Moth (*Platyptilia carduidactyla*); Azalea Caterpillar (*Datana major*); Bagworm (*Thyridopteryx*); *ephemeraeformis*); Banana Moth (*Hypercompe scribonia*); Banana Skipper (*Erionota thrax*); Blackheaded Budworm (*Acleris gloverana*); California Oakworm (*Phryganidia californica*); Spring Cankerworm (*Paleacrita merriccata*); Cherry Fruitworm (*Grapholita packardi*); China Mark Moth (*Nymphula stagnata*); Citrus Cutworm (*Xylomyges curialis*); Codling Moth (*Cydia pomonella*); Cranberry Fruitworm (*Acrobasis vaccinii*); Cross-striped Cabbageworm (*Evergestis rimosalis*); Cutworm (*Noctuid* species, *Agrotis ipsilon*); Douglas Fir Tussock Moth (*Orgyia pseudotsugata*); Ello Moth (Hornworm) (*Erinnyis ello*); Elm Spanworm (*Ennomos subsignaria*); European Grapevine Moth (*Lobesia botrana*); European Skipper (*Thymelicus lineola* (Essex Skipper); Fall Webworm (*Melissopus latiferreanus*; Filbert Leafroller (*Archips rosanus*; Fruittree Leafroller (*Archips argyrospilia*; Grape Berry Moth (*Paralobe-*

*sia viteana*); Grape Leafroller (*Platynota stultana*); Grapeleaf Skeletonizer (*Harrisina americana* (ground only)); Green Cloverworm (*Plathypena scabra*); Greenstriped Mapleworm (*Dryocampa rubicunda*); Gummosos-Batrachedra; Comosae (Hodges); Gypsy Moth (*Lymantria dispar*); Hemlock Looper (*Lambdina fiscellaria*); Hornworm (*Manduca* spp.); Imported Cabbageworm (*Pieris rapae*); Io Moth (*Automeris io*); Jack Pine Budworm (*Choristoneura pinus*); Light Brown Apple Moth (*Epiphyas postvittana*); Melonworm (*Diaphania hyalinata*); Mimosa Webworm (*Homadaula anisocentra*); Obliquebanded Leafroller (*Choristoneura rosaceana*); Oleander Moth (*Syntomeida epilais*); Omnivorous Leafroller (*Playnota stultana*); Omnivorous Looper (*Sabulodes aegrotata*); Orangedog (*Papilio cresphontes*); Orange Tortrix (*Argyrotaenia citrana*); Oriental Fruit Moth (*Grapholita molesta*); Peach Twig Borer (*Anarsia lineatella*); Pine Butterfly (*Neophasia menapia*); Podworm (*Heliocoverpa zea*); Redbanded Leafroller (*Argyrotaenia velutinana*); Redhumped Caterpillar (*Schizura concinna*); Rindworm Complex (*Various* Leps.); Saddleback Caterpillar (*Sibine stimulea*); Saddle Prominent Caterpillar *Heterocampa guttivitta*); Saltmarsh Caterpillar (*Estigmene acrea*); Sod Webworm (*Crambus* spp.); Spanworm (*Ennomos subsignaria*); Fall Cankerworm (*Alsophila pometaria*); Spruce Budworm (*Choristoneura fumiferana*); Tent Caterpillar (Various Lasiocampidae); Thecla-Thecla Basilides (Geyr) *Thecla basilides*); Tobacco Hornworm (*Manduca sexta*); Tobacco Moth (*Ephestia elutella*); Tufted Apple Budmoth (*Platynota idaeusalis*); Twig Borer (*Anarsia lineatella*); Variegated Cutworm (*Peridroma saucia*); Variegated Leafroller (*Platynota flavedana*); Velvetbean Caterpillar (*Anticarsia gemmatalis*); Walnut Caterpillar (*Datana integerrima*); Webworm (*Hyphantria cunea*); Western Tussock Moth (*Orgyia vetusta*); Southern Cornstalk Borer (*Diatraea crambidoides*); Corn Earworm; Sweet potato weevil; Pepper weevil; Citrus root weevil; Strawberry root weevil; Pecan weevil; Filbert weevil; Ricewater weevil; Alfalfa weevil; Clover weevil; Tea shot-hole borer; Root weevil; Sugarcane beetle; Coffee berry borer; Annual blue grass weevil (*Listronotus maculicollis*); Asiatic garden beetle (*Maladera castanea*); European chafer (*Rhizotroqus majalis*); Green June beetle (*Cotinis nitida*); Japanese beetle (*Popillia japonica*); May or June beetle (*Phyllophaga* sp.); Northern masked chafer (*Cyclocephala borealis*); Oriental beetle (*Anomala orientalis*); Southern masked chafer (*Cyclocephala lurida*); Billbug (*Curculionoidea*); Aedes aegypti; Busseola fusca; Chilo suppressalis; Culex pipiens; Culex quinquefasciatus; Diabrotica virgifera; Diatraea saccharalis; Helicoverpa armigera; Helicoverpa zea; Heliothis virescens; Leptinotarsa decemlineata; Ostrinia furnacalis; Ostrinia nubilalis; Pectinophora gossypiella; Plodia interpunctella; Plutella xylostella; Pseudoplusia includens; Spodoptera exigua; Spodoptera frugiperda; Spodoptera littoralis; Trichoplusia ni; and Xanthogaleruca luteola.

22. A method to control Bacillus thuringiensis-toxin-resistant insects using the combination of claim 1, the method comprising, providing the combination and then applying said combination to the locus of an insect.

23. The method of claim 22, wherein the *Bacillus* thuringiensis-toxin-resistant insects are selected from the group consisting of: *Aedes aegypti; Busseola fusca; Chilo suppressalis; Culex pipiens; Culex quinquefasciatus; Diabrotica virgifera; Diatraea saccharalis; Helicoverpa armigera; Helicoverpa zea; Heliothis virescens; Leptinotarsa decemlineata; Ostrinia furnacalis; Ostrinia nubilalis; Pectinophora gossypiella; Plodia interpunctella; Plutella xylostella; Pseudoplusia includens; Spodoptera exigua; Spodoptera frugiperda; Spodoptera littoralis; Trichoplusia ni*; and *Xanthogaleruca luteola.*

24. A method of combating, controlling, or inhibiting a pest comprising, applying a pesticidally effective amount of the combination of claim 1 to the locus of the pest, or to a plant or animal susceptible to an attack by the pest.

25. The method of claim 24, wherein the pest is selected from the group consisting of: Achema Sphinx Moth (Hornworm) (*Eumorpha achemon*); Alfalfa Caterpillar (*Colias eurytheme*); Almond Moth (*Caudra cautella*); Amorbia Moth (*Amorbia humerosana*); Armyworm (*Spodoptera* spp., e.g. exigua, frugiperda, littoralis, *Pseudaletia unipuncta*); Artichoke Plume Moth (*Platyptilia carduidactyla*); Azalea Caterpillar (*Datana major*); Bagworm (*Thyridopteryx*); ephemeraeformis); Banana Moth (*Hypercompe scribonia*); Banana Skipper (*Erionota thrax*); Blackheaded Budworm (*Acleris gloverana*); California Oakworm (*Phryganidia californica*); Spring Cankerworm (*Paleacrita merriccata*); Cherry Fruitworm (*Grapholita packardi*); China Mark Moth (*Nymphula stagnata*); Citrus Cutworm (*Xylomyges curialis*); Codling Moth (*Cydia pomonella*); Cranberry Fruitworm (*Acrobasis vaccinii*); Cross-striped Cabbageworm (*Evergestis rimosalis*); Cutworm (*Noctuid* species, *Agrotis ipsilon*); Douglas Fir Tussock Moth (*Orgyia pseudotsugata*); Ello Moth (Hornworm) (*Erinnyis ello*); Elm Spanworm (*Ennomos subsignaria*); European Grapevine Moth (*Lobesia botrana*); European Skipper (*Thymelicus lineola* (Essex Skipper); Fall Webworm (*Melissopus latiferreanus*; Filbert Leafroller (*Archips rosanus*; Fruittree Leafroller (*Archips argyrospilia*; Grape Berry Moth (*Paralobesia viteana*; Grape Leafroller (*Platynota stultana*; Grapeleaf Skeletonizer (*Harrisina americana* (ground only); Green Cloverworm (*Plathypena scabra*; Greenstriped Mapleworm (*Dryocampa rubicunda*; Gummosos-Batrachedra; Comosae (Hodges); Gypsy Moth (*Lymantria dispar*); Hemlock Looper (*Lambdina fiscellaria*); Hornworm (*Manduca* spp.); Imported Cabbageworm (*Pieris rapae*); Io Moth (*Automeris io*); Jack Pine Budworm (*Choristoneura pinus*); Light Brown Apple Moth (*Epiphyas postvittana*); Melonworm (*Diaphania hyalinata*); Mimosa Webworm (*Homadaula anisocentra*); Obliquebanded Leafroller (*Choristoneura rosaceana*); Oleander Moth (*Syntomeida epilais*); Omnivorous Leafroller (*Playnota stultana*); Omnivorous Looper (*Sabulodes aegrotata*); Orangedog (*Papilio cresphontes*); Orange Tortrix (*Argyrotaenia citrana*); Oriental Fruit Moth (*Grapholita molesta*); Peach Twig Borer (*Anarsia lineatella*); Pine Butterfly (*Neophasia menapia*); Podworm (*Heliocoverpa zea*); Redbanded Leafroller (*Argyrotaenia velutinana*); Redhumped Caterpillar (*Schizura concinna*); Rindworm Complex (*Various* Leps.); Saddleback Caterpillar (*Sibine stimulea*); Saddle Prominent Caterpillar *Heterocampa guttivitta*); Saltmarsh Caterpillar (*Estigmene acrea*); Sod Webworm (*Crambus* spp.); Spanworm (*Ennomos subsignaria*); Fall Cankerworm (*Alsophila pometaria*); Spruce Budworm (*Choristoneura fumiferana*); Tent Caterpillar (*Various* Lasiocampidae); Thecla-Thecla Basilides (Geyr) *Thecla basilides*); Tobacco Hornworm (*Manduca sexta*); Tobacco Moth (*Ephestia elutella*); Tufted Apple Budmoth (*Platynota idaeusalis*); Twig Borer (*Anarsia lineatella*); Variegated Cutworm (*Peridroma saucia*); Variegated Leafroller (*Platynota flavedana*); Velvetbean Caterpillar (*Anticarsia gemmatalis*); Walnut Caterpillar (*Datana integerrima*); Webworm (*Hyphantria cunea*); Western Tussock Moth (*Orgyia vetusta*); Southern Cornstalk Borer (*Diatraea crambidoides*); Corn Earworm; Sweet potato weevil; Pepper weevil; Citrus root weevil; Strawberry root weevil; Pecan weevil; Filbert weevil; Ricewater weevil; Alfalfa weevil; Clover weevil; Tea shot-hole borer; Root weevil; Sugarcane beetle; Coffee berry borer; Annual blue grass weevil (*Listronotus maculicollis*); Asiatic garden beetle (*Maladera castanea*); European chafer (*Rhizotroqus majalis*); Green June beetle (*Cotinis nitida*); Japanese beetle (*Popillia japonica*); May or June beetle (*Phyllophaga* sp.); Northern masked chafer (*Cyclocephala borealis*); Oriental beetle (*Anomala orientalis*); Southern masked chafer (*Cyclocephala lurida*); Billbug (*Curculionoidea*); *Aedes aegypti; Busseola fusca; Chilo suppressalis; Culex pipiens; Culex quinquefasciatus; Diabrotica virgifera; Diatraea saccharalis; Helicoverpa armigera; Helicoverpa zea; Heliothis virescens; Leptinotarsa decemlineata; Ostrinia furnacalis; Ostrinia nubilalis; Pectinophora gossypiella; Plodia interpunctella; Plutella xylostella; Pseudoplusia includens; Spodoptera exigua; Spodoptera frugiperda; Spodoptera littoralis; Trichoplusia ni*; and *Xanthogaleruca luteola*.

26. The method of claim 25, wherein the pest is selected from the group consisting of: *Aedes aegypti; Busseola fusca; Chilo suppressalis; Culex pipiens; Culex quinquefasciatus; Diabrotica virgifera; Diatraea saccharalis; Helicoverpa armigera; Helicoverpa zea; Heliothis virescens; Leptinotarsa decemlineata; Ostrinia furnacalis; Ostrinia nubilalis; Pectinophora gossypiella; Plodia interpunctella; Plutella xylostella; Pseudoplusia includens; Spodoptera exigua; Spodoptera frugiperda; Spodoptera littoralis; Trichoplusia ni*; and *Xanthogaleruca luteola*.

\* \* \* \* \*